(12) United States Patent
Li et al.

(10) Patent No.: US 12,378,558 B2
(45) Date of Patent: Aug. 5, 2025

(54) RNAi AGENTS FOR INHIBITING EXPRESSION OF COMPLEMENT FACTOR B (CFB), PHARMACEUTICAL COMPOSITIONS THEREOF, AND METHODS OF USE

(71) Applicant: Arrowhead Pharmaceuticals, Inc., Pasadena, CA (US)

(72) Inventors: Xiaokai Li, San Diego, CA (US); Tao Pei, Middleton, WI (US); Casi Schienebeck, Deerfield, WI (US); Yichen Wang, San Diego, CA (US); Zhi-Ming Ding, Waunakee, WI (US); Grigoriy Shekhtman, Los Angeles, CA (US)

(73) Assignee: Arrowhead Pharmaceuticals, Inc., Pasadena, CA (US)

( * ) Notice: Subject to any disclaimer, the term of this patent is extended or adjusted under 35 U.S.C. 154(b) by 0 days.

(21) Appl. No.: 18/610,930

(22) Filed: Mar. 20, 2024

(65) Prior Publication Data

US 2025/0215433 A1    Jul. 3, 2025

Related U.S. Application Data

(60) Provisional application No. 63/566,013, filed on Mar. 15, 2024, provisional application No. 63/491,505, filed on Mar. 21, 2023.

(51) Int. Cl.
*C12N 15/113* (2010.01)
*A61P 13/12* (2006.01)
*C12N 15/63* (2006.01)

(52) U.S. Cl.
CPC ......... *C12N 15/1137* (2013.01); *A61P 13/12* (2018.01); *C12N 15/63* (2013.01);
(Continued)

(58) Field of Classification Search
CPC ............... C12N 15/1137; C12N 15/63; C12N 2310/14; C12N 2310/315; C12N 2310/351; C12N 2310/11
See application file for complete search history.

(56) References Cited

U.S. PATENT DOCUMENTS

| 4,522,811 A | 6/1985 | Eppstein et al. |
| 5,885,968 A | 3/1999 | Biessen et al. |

(Continued)

FOREIGN PATENT DOCUMENTS

| WO | 2000053722 A2 | 9/2000 |
| WO | 2006006948 A2 | 1/2006 |

(Continued)

OTHER PUBLICATIONS

Altenhofer EF, Lawler MJ, Kumar P, Joyce LA, Fowler-Watters M, Pei T, Li Z. Synthesis of a novel cyclopropyl phosphonate nucleotide as a phosphate mimic. Chem Commun (Camb). Jul. 1, 20214;57(55):6808-6811. doi: 10.1039/d1cc02328d. Epub Jun. 18, 2021. PMID: 34142689.

(Continued)

*Primary Examiner* — Ram R Shukla
*Assistant Examiner* — Shabana S Meyering
(74) *Attorney, Agent, or Firm* — Mitchell Porter; Paul Vander Velde; Meibo Chen

(57) ABSTRACT

The present disclosure relates to RNAi agents able to inhibit Complement Factor B (CFB) gene expression. Also disclosed are pharmaceutical compositions that include CFB RNAi agents and methods of use thereof. The CFB RNAi agents disclosed herein may be conjugated to targeting ligands, including ligands that comprise N-acetyl-galactosanine, to facilitate the in vivo delivery to hepatocyte cells. The RNAi agents can be used in methods of treatment of diseases, disorders, or symptoms mediated in part by CFB (Continued)

gene expression, including IgA nephropathy (IgAN), C3 glomerulopathy (C3G), immune complex-mediated membranoproliferative glomerulonephritis (IC-MPGN), lupus nephritis (LN), Anti-Glomerular Basement Membrane disease (anti-GBM), ischemia reperfusion injury and T-cell mediated rejection (TCMR) in kidney transplantation, anti-neutrophil cytoplasmic antibody (ANCA)-associated vasculitis, age-related macular degeneration (AMD), including early and/or intermediate AMD, geographic atrophy (GA), glaucoma, Doyne honeycomb retinal dystrophy, paroxysmal nocturnal hemoglobinuria (PNH), atypical hemolytic uremic syndrome (aHUS), pre-eclampsia, rheumatoid arthritis (RA), and/or other complement-mediated diseases.

19 Claims, 39 Drawing Sheets

Specification includes a Sequence Listing.

(52) U.S. Cl.
CPC .... *C12N 2310/14* (2013.01); *C12N 2310/315* (2013.01); *C12N 2310/351* (2013.01)

(56) References Cited

U.S. PATENT DOCUMENTS

| | | | |
|---|---|---|---|
| 5,998,203 | A | 12/1999 | Matulic-Adamic et al. |
| 10,000,753 | B2 | 6/2018 | Suhy et al. |
| 11,186,842 | B2 | 11/2021 | Borodovsky et al. |
| 2016/0145611 | A1* | 5/2016 | Suhy .................. C12N 15/1137 536/24.5 |
| 2023/0257749 | A1 | 8/2023 | McIninch et al. |

FOREIGN PATENT DOCUMENTS

| | | |
|---|---|---|
| WO | 2008022309 A2 | 2/2008 |
| WO | 2009049166 A2 | 4/2009 |
| WO | 2011104169 A1 | 1/2011 |
| WO | 2012083185 A2 | 6/2012 |
| WO | 2013032829 A1 | 7/2013 |
| WO | 2013158141 A1 | 10/2013 |
| WO | 2014107763 A1 | 7/2014 |
| WO | 2015089368 A2 | 6/2015 |
| WO | 2017156012 A1 | 9/2017 |
| WO | 2017214112 A1 | 12/2017 |
| WO | 2018044350 A1 | 3/2018 |
| WO | 2019027015 A1 | 2/2019 |
| WO | 2021222549 A1 | 11/2021 |
| WO | 2023018523 A2 | 2/2023 |
| WO | 2023031359 A1 | 3/2023 |
| WO | WO-2023076451 A1 * | 5/2023 ........... A61K 31/713 |
| WO | 2023097291 A1 | 6/2023 |
| WO | WO-2023129496 A2 * | 7/2023 |

OTHER PUBLICATIONS

Baenziger JU, Fiete D. Galactose and N-acetylgalactosamine-specific endocytosis of glycopeptides by isolated rat hepatocytes. Cell. Nov. 1980;22(2 Pt 2):611-20. doi: 10.1016/0092-8674(80)90371-2. PMID: 7448875.

Barratt, J. et al.; "Efficacy and Safety of Iptacopan in IGA Nephropathy: Results of a Randomized Double-Blind Placebo-Controlled Phase 2 Study at 6 Months"; Kidney International Reports; WCN'22, Kuala Lumpur, Malaysia; 2022; 7; S236.

Biessen EA, Beuting DM, Roelen HC, van de Marel GA, van Boom JH, van Berkel TJ. Synthesis of cluster galactosides with high affinity for the hepatic asialoglycoprotein receptor. J Med Chem. Apr. 28, 1995;38(9):1538-46. doi: 10.1021/jm00009a014. PMID: 7739012.

Blakey H, Sun R, Xie L, Russell R, Sarween N, Hodson J, Hargitai B, Marton T, A H Neil D, Wong E, Sheerin NS, Bramham K, Harris CL, Knox E, Drayson M, Lipkin G. Pre-eclampsia is associated with complement pathway activation in the maternal and fetal circulation, and placental tissue. Pregnancy Hypertens. Jun. 2023; 32:43-49. doi: 10.1016/j.preghy.2023.04.001. Epub Apr. 21, 2023. PMID: 37088032.

Casiraghi F, Azzollini N, Todeschini M, Fiori S, Cavinato RA, Cassis P, Solini S, Pezzuto F, Mister M, Thurman JM, Benigni A, Remuzzi G, Noris M. Complement Alternative Pathway Deficiency in Recipients Protects Kidney Allograft From Ischemia/Reperfusion Injury and Alloreactive T Cell Response. Am J Transplant. Sep. 2017;17(9):2312-2325. doi: 10.1111/ajt.14262. Epub Apr. 10, 2017. PMID: 28276660.

Chen K, Deng Y, Shang S, Tang L, Li Q, Bai X, Chen X. Complement factor B inhibitor LNP023 improves lupus nephritis in MRL/lpr mice. Biomed Pharmacother. Sep. 2022;153:113433. doi: 10.1016/j.biopha.2022.113433. Epub Jul. 26, 2022. PMID: 36076550.

Connolly DT, Townsend RR, Kawaguchi K, Bell WR, Lee YC. Binding and endocytosis of cluster glycosides by rabbit hepatocytes. Evidence for a short-circuit pathway that does not lead to degradation. J Biol Chem. Jan. 25, 1982;257 (2):939-45. PMID: 7054189.

Crowley MA, Garland DL, Sellner H, Banks A, Fan L, Rejtar T, Buchanan N, Delgado O, Xu YY, Jose S, Adams CM, Mogi M, Wang K, Bigelow CE, Poor S, Anderson K, Jaffee BD, Prasanna G, Grosskreutz C, Fernandez-Godino R, Pierce EA, Dryja TP, Liao SM. Complement factor B is critical for sub-RPE deposit accumulation in a model of Doyne honeycomb retinal dystrophy with features of age-related macular degeneration. Hum Mol Genet. Jan. 6, 2023;32 (2):204-217. doi: 10.1093/hmg/ddac187. PMID: 35943778; PMCID: PMC9840207.

Czauderna F, Fechtner M, Dames S, Aygün H, Klippel A, Pronk GJ, Giese K, Kaufmann J. Structural variations and stabilising modifications of synthetic siRNAs in mammalian cells. Nucleic Acids Res. Jun. 1, 2003;31(11):2705-16. doi: 10.1093/nar/gkg393. PMID: 12771196; PMCID: PMC156727.

Defendi F, Thielens NM, Clavarino G, Cesbron JY, Dumestre-Pérard C. The Immunopathology of Complement Proteins and Innate Immunity in Autoimmune Disease. Clin Rev Allergy Immunol. Apr. 2020;58(2):229-251. doi: 10.1007/s12016-019-08774-5. PMID: 31834594.

Dolezal, Patrick et al.; "Taking the Alternative Path(way): A Deep Dive on the Complement System and the Blockbuster Complement Market"; LifeSci Capital/Alpha Series; Sector Analysis; Dec. 20, 2022; pp. 1-42.

Garred P, Tenner AJ, Mollnes TE. Therapeutic Targeting of the Complement System: From Rare Diseases to Pandemics. Pharmacol Rev. Apr. 2021;73(2):792-827. doi: 10.1124/pharmrev.120.000072. PMID: 33687995; PMCID: PMC7956994.

Gleeson PJ, O'Shaughnessy MM, Barratt J. IgA nephropathy in adults-treatment standard. Nephrol Dial Transplant. Oct. 31, 2023;38(11):2464-2473. doi: 10.1093/ndt/gfad146. PMID: 37418237; PMCID: PMC10794095.

Grossman TR, Carrer M, Shen L, Johnson RB, Hettrick LA, Henry SP, Monia BP, McCaleb ML. Reduction in ocular complement factor B protein in mice and monkeys by systemic administration of factor B antisense oligonucleotide. Mol Vis. Aug. 10, 2017;23:561-571. PMID: 28855795; PMCID: PMC5563462.

Hillmen P, Szer J, Weitz I, Röth A, Höchsmann B, Panse J, Usuki K, Griffin M, Kiladjian JJ, de Castro C, Nishimori H, Tan L, Hamdani M, Deschatelets P, Francois C, Grossi F, Ajayi T, Risitano A, Peffault de Latour R. Pegcetacoplan versus Eculizumab in Paroxysmal Nocturnal Hemoglobinuria. N Engl J Med. Mar. 18, 2021;384(11):1028-1037. doi: 10.1056/NEJMoa2029073. Erratum in: N Engl J Med. Mar. 14, 2024;390(11):1060. PMID: 33730455.

Holers VM, Banda NK. Complement in the Initiation and Evolution of Rheumatoid Arthritis. Front Immunol. May 28, 2018;9:1057. doi: 10.3389/fimmu.2018.01057. PMID: 29892280; PMCID: PMC5985368.

Hoppe C, Gregory-Ksander M. The Role of Complement Dysregulation in Glaucoma. Int J Mol Sci. Feb. 15, 2024;25 (4):2307. doi: 10.3390/ijms25042307. PMID: 38396986; PMCID: PMC10888626.

Iobst ST, Drickamer K. Selective sugar binding to the carbohydrate recognition domains of the rat hepatic and macrophage

(56) References Cited

OTHER PUBLICATIONS asialoglycoprotein receptors. J Biol Chem. Mar. 22, 1996;271(12):6686-93. doi: 10.1074/jbc.271.12.6686. PMID: 8636087.

Kamola PJ, Nakano Y, Takahashi T, Wilson PA, Ui-Tei K. The siRNA Non-seed Region and Its Target Sequences Are Auxiliary Determinants of Off-Target Effects. PLoS Comput Biol. Dec. 11, 2015; 11(12):e1004656. doi: 10.1371/journal.pcbi.1004656. PMID: 26657993; PMCID: PMC4676691.

Peffault de Latour R, et al.; Oral Iptacopan Monotherapy in Paroxysmal Nocturnal Hemoglobinuria. N Engl J Med. Mar. 14, 2024;390(11):994-1008. doi: 10.1056/NEJMoa2308695. PMID: 38477987.

Poppelaars F, Thurman JM. Complement-mediated kidney diseases. Mol Immunol. Dec. 2020;128:175-187. doi: 10.1016/j.molimm.2020.10.015. Epub Nov. 1, 2020. PMID: 33137606.

Schröder-Braunstein J, Kirschfink M. Complement deficiencies and dysregulation: Pathophysiological consequences, modern analysis, and clinical management. Mol Immunol. Oct. 2019;114:299-311. doi: 10.1016/j.molimm.2019.08.002. Epub Aug. 14, 2019. PMID: 31421540.

Sun ZJ, Chang DY, Chen M, Zhao MH. Deficiency of CFB attenuates renal tubulointerstitial damage by inhibiting ceramide synthesis in diabetic kidney disease. JCI Insight. Dec. 22, 2022;7(24):e156748. doi: 10.1172/jci.insight.156748. PMID: 36546481; PMCID: PMC9869976.

Thurman JM, Holers VM. The central role of the alternative complement pathway in human disease. J Immunol. Feb. 1, 2006;176(3):1305-10. doi: 10.4049/jimmunol.176.3.1305. PMID: 16424154.

Van Lookeren Campagne M, Strauss EC, Yaspan BL. Age-related macular degeneration: Complement in action. Immunobiology. Jun. 2016;221(6):733-9. doi: 10.1016/j.imbio.2015.11.007. Epub Dec. 19, 2015. PMID: 26742632.

Wong EKS, Kavanagh D. Diseases of complement dysregulation-an overview. Semin Immunopathol. Jan. 2018;40 (1):49-64. doi: 10.1007/s00281-017-0663-8. Epub Jan. 11, 2018. PMID: 29327071; PMCID: PMC5794843.

Zanchi C, Locatelli M, Corna D, Cerullo D, Fishilevich E, Desai D, Rottoli D, Donadelli R, Noris M, Zoja C, Remuzzi G, Benigni A. Liver factor B silencing to cure C3 glomerulopathy: Evidence from a mouse model of complement dysregulation. Mol Immunol. Sep. 2023;161:25-32. doi: 10.1016/j.molimm.2023.07.010. Epub Jul. 21, 2023. PMID: 37481826.

Zhang G, Budker V, Wolff JA. High levels of foreign gene expression in hepatocytes after tail vein injections of naked plasmid DNA. Hum Gene Ther. Jul. 1, 1999;10(10):1735-7. doi: 10.1089/10430349950017734. PMID: 10428218.

GenBank NM_001710.6; "*Homo sapiens* complement factor B (Cfb), mRNA" (2023).

* cited by examiner

RNAi AGENTS FOR INHIBITING EXPRESSION OF COMPLEMENT FACTOR B (CFB), PHARMACEUTICAL COMPOSITIONS THEREOF, AND METHODS OF USE

CROSS REFERENCE TO RELATED APPLICATIONS

This application claims the benefit of priority to U.S. Provisional Patent Application Ser. No. 63/491,505, filed on 21 Mar. 2023 and U.S. Provisional Patent Application Ser. No. 63/566,013, filed on 15 Mar. 2024, the contents of each of which are incorporated herein by reference in their entirety.

FIELD OF THE INVENTION

The present disclosure relates to RNA interference (RNAi) agents, e.g., double stranded RNAi agents such as chemically modified small interfering RNA (siRNA), for inhibition of Complement Factor B (CFB) gene expression, pharmaceutical compositions that include CFB RNAi agents, and methods of use thereof for the treatment of CFB-related diseases and disorders.

SEQUENCE LISTING

This application contains a Sequence Listing (in compliance with Standard ST26), which has been submitted in xml format and is hereby incorporated by reference in its entirety. The xml sequence listing file is named 30719-US1_SeqListing.xml, created Mar. 20, 2024, and is 5,186,719 bytes in size.

BACKGROUND

The complement cascade is a crucial part of the innate immune system, providing the first line of defense against infections and orchestrating removal of apoptotic cells and debris by marking them for disposal. (Defendi et al., *Clin Rev Allergy Immunol.* 2020, 58(2):229-51). However, dysregulated activation of the complement system can lead to progression of certain renal diseases, either by playing a directly pathogenic role, or by amplifying or exacerbating the inflammatory and damaging impact of non-complement disease triggers. (Schroder-Braunstein et al., *Mol Immunol.* 2019, 114:299-311).

The complement system can be activated through three distinct pathways: the alternative pathway, the classical pathway, and the lectin pathway. Each of the three pathways of complement activity has important physiologic functions and can play a role in the pathogenesis of various diseases. Activation of the complement system eventually converges on the formation of the Membrane Attack Complex (MAC), the cytotoxic unit of the system, while fragments of complement proteins produced during its activation can serve as opsonins or pro-inflammatory chemoattractants. An overview of the complement system is described in Garred et al., *Pharmacol. Rev.* 2021, 73:792-827 (see, e.g., FIG. 1 therein).

Complement factor B (CFB) is a central component of the alternative pathway of the complement system. It has been previously identified as a potential therapeutic target for diseases associated with complement dysregulation involving the alternative pathway, such as IgA nephropathy (IgAN), C3 glomerulopathy (C3G), immune complex-mediated membranoproliferative glomerulonephritis (IC-MPGN), lupus nephritis (LN), Anti-Glomerular Basement Membrane disease (anti-GBM), ischemia reperfusion injury and T-cell mediated rejection (TCMR) in kidney transplantation, anti-neutrophil cytoplasmic antibody (ANCA)-associated vasculitis, age-related macular degeneration (AMD), including early and/or intermediate AMD, geographic atrophy (GA), glaucoma, Doyne honeycomb retinal dystrophy, paroxysmal nocturnal hemoglobinuria (PNH), atypical hemolytic uremic syndrome (aHUS), pre-eclampsia, rheumatoid arthritis (RA), and/or other complement-mediated diseases (van Lookeren et al., Immunobiology 2016, 221: 733-739; Casiraghi et al., *Am. J. Transplantation* 2017, 17:2312-2325; Wong & Kavanaugh, *Semninars in Immunopathology* 2018, 40:49-64; Holers & Banda, *Frontiers in Immunology* 2018, 9:1057 Poppelaars & Thurman, *Molecular Immunology*, 2020, 188:175-187, Crowley et al., *Human Molecular Genetics*, 2023, 32(2):204-217; Blakey et al., *Int'l J. Women's Cardiovascular Health* 2023, 32:43-49; Hoppe & Gregory-Ksander *Int'l J. Med. Sci.* 2024, 25:2307). However, despite considerable interest in developing complement-targeted therapies for the treatment of one or more of these conditions, there remains significant unmet medical need.

For example, current management of IgAN and C3G is limited to supportive care (including lifestyle modification and renoprotective medications targeting the renin-angiotensin system) and broadly-acting immunosuppressive agents (including corticosteroids and mycophenolate mofetil), which have significant limitations owing to their lack of specificity for the underlying disease process and/or unfavorable side effect profile with long-term use (Gleeson & O'Shaugnessy, *Nephrol Dial Transplant*, 2023, 38:2464-2473). No complement-targeting therapies for either IgAN or C3G have been approved despite broad recognition of the role of complement dysregulation in their pathophysiology. In PNH, agents targeting the alternative complement pathway have demonstrated improved clinical outcomes compared to existing, more broadly-acting therapies, leading to their approval and highlighting the potential advantage of therapies that more precisely target the pathophysiology of disease and complement dysregulation specifically (Hillmen et al., *NEJMED* 2021, 384:1028-37; Peffault de Latour et al., *NEJMED* 2022, 390:994-1008).

While complement inhibitors targeting the alternative pathway are being developed as potential therapeutics for some complement-mediated diseases, there are significant limitations and challenges with their development. For example, agents that broadly inhibit the complement cascade can greatly increase the risk of infections and other adverse events. For diseases where dysregulation of the alternative pathway has specifically been implicated, it would be far more preferable to selectively target this pathway, leaving the classical and lectin pathways intact. Among CFB inhibitors currently in development, delivery and adherence issues are also a concern. Some CFB inhibitors are large molecules, such as monoclonal antibodies, which typically require intravenous administration and have limited tissue penetration. Alternatively, there are certain orally delivered small-molecule CFB inhibitors in development that simplify delivery but require frequent administration, as much as twice daily (BID), which can increase medication burden for patients and predispose to rebound effects when doses are missed.

Further, specifically targeting CFB offers a potential advantage over targeting other complement components due to its central role in complement activation and well-characterized association with disease susceptibility. Targeted CFB inhibition may leave other pathways of the complement system intact and reduce the patient's susceptibility to infections caused by inhibition of the classical and lectin pathways. An approach utilizing the RNAi mechanism to target CFB also offers potential advantages with regards to simplicity of administration via the subcutaneous enroute and infrequent dosing. While various publications have proposed siRNAs or other oligonucleotide molecules for targeting CFB, none of the previously disclosed inhibitory molecules has shown the necessary combination of sufficient gene silencing, a suitable safety profile, and the stability and prolonged inhibitory activity to require in-frequent administration to resolve any adherence issues for certain patients that have trouble with any existing therapies or known therapeutic candidates.

SUMMARY

There exists a need for novel RNA interference (RNAi) agents (termed RNAi agents, RNAi triggers, or triggers), e.g., double stranded RNAi agents, that are able to selectively and efficiently inhibit CFB gene expression. Further, there exists a need for compositions of novel CFB-specific RNAi agents for use as a therapeutic or medicament for the treatment of diseases or disorders related to dysregulation of the alternative complement pathway, including as non-limiting examples: IgA nephropathy (IgAN), C3 glomerulopathy (C3G), immune complex-mediated membranoproliferative glomerulonephritis (IC-MPGN), lupus nephritis (LN), Anti-Glomerular Basement Membrane disease (anti-GBM), ischemia reperfusion injury and T-cell mediated rejection (TCMR) in kidney transplantation, anti-neutrophil cytoplasmic antibody (ANCA)-associated vasculitis, age-related macular degeneration (AMD), including early and/or intermediate AMD, geographic atrophy (GA), glaucoma, Doyne honeycomb retinal dystrophy, paroxysmal nocturnal hemoglobinuria (PNH), atypical hemolytic uremic syndrome (aHUS), pre-eclampsia, rheumatoid arthritis (RA), and/or other complement-mediated diseases (van Lookeren et al., 2016, Casiraghi et al., 2017, Wong & Kavanaugh 2018, Holers & Banda 2018, Poppelaars & Thurman 2020, Crowley et al., 2023, Blakey et al., 2023, Hoppe & Gregory-Ksander 2024).

The nucleotide sequences and chemical modifications of the CFB RNAi agents disclosed herein differ from those previously disclosed or known in the art. The CFB RNAi agents disclosed herein provide for highly specific, potent and efficient in vivo inhibition of the expression of a CFB gene.

In some embodiments, the sense strand comprises a nucleotide sequence of at least 15 contiguous nucleotides differing by 0 or 1 nucleotides from 15 contiguous nucleotides of any one of the sense strand sequences of Table 2, Table 4A, Table 4B, or Table 5C, and wherein the sense strand has a region of at least 85% complementarity over the 15 contiguous nucleotides to the antisense strand.

In some embodiments, at least one nucleotide of the RNAi agent includes a modified internucleoside linkage.

In some embodiments, the modified nucleotides of the CFB RNAi agents disclosed herein are selected from the group consisting of: 2'-O-methyl nucleotide, 2'-fluoro nucleotide, 2'-deoxy nucleotide, 2',3'-seco nucleotide mimic, locked nucleotide, 2'-F-arabino nucleotide, 2'-methoxyethyl nucleotide, abasic nucleotide, ribitol, inverted nucleotide, inverted 2'-O-methyl nucleotide, inverted 2'-deoxy nucleotide, 2'-amino-modified nucleotide, 2'-alkyl-modified nucleotide, morpholine-containing nucleotide (such as replacing the ribose ring with a methylenemorpholine ring), vinyl phosphonate containing nucleotide, cyclopropyl phosphonate containing nucleotide, and 3'-O-methyl nucleotide.

In other embodiments, all or substantially all of the modified nucleotides of the RNAi agents disclosed herein are 2'-O-methyl nucleotides, 2'-fluoro nucleotides, or combinations thereof.

In some embodiments, the antisense strand consists of, consists essentially of, or comprises the nucleotide sequence of any one of the modified antisense strand sequences of Table 3.

In some embodiments, the sense strand consists of, consists essentially of, or comprises the nucleotide sequence of any of the modified sense strand sequences of Table 4A or Table 4B.

In some embodiments, the antisense strand comprises the nucleotide sequence of any one of the modified sequences of Table 3 and the sense strand comprises the nucleotide sequence of any one of the modified sequences of Table 4A or Table 4B.

The RNAi agents disclosed herein are linked to a targeting ligand that comprises N-acetyl-galactosamine. In further embodiments, the targeting ligand is linked to the sense strand. In some embodiments, the targeting ligand is linked to the 5' terminal end of the sense strand.

In some embodiments, the sense strand is between 15 and 30 nucleotides in length, and the antisense strand is between 18 and 30 nucleotides in length. In other embodiments, the sense strand and the antisense strand are each between 19 and 27 nucleotides in length. In other embodiments, the sense strand and the antisense strand are each between 21 and 24 nucleotides in length. In still other embodiments, sense strand and the antisense strand are each 21 nucleotides in length.

In some embodiments, the RNAi agents have two blunt ends.

In some embodiments, the sense strand comprises one or two terminal caps. In other embodiments, the sense strand comprises one or two inverted abasic residues.

In some embodiments, the RNAi agents are comprised of a sense strand and an antisense strand that form a duplex sequence of the duplex structures shown in Table 5C.

In some embodiments, the sense strand further includes inverted abasic residues at the 3' terminal end of the nucleotide sequence, at the 5' end of the nucleotide sequence, or at both.

In further embodiments, the targeting ligand comprises:

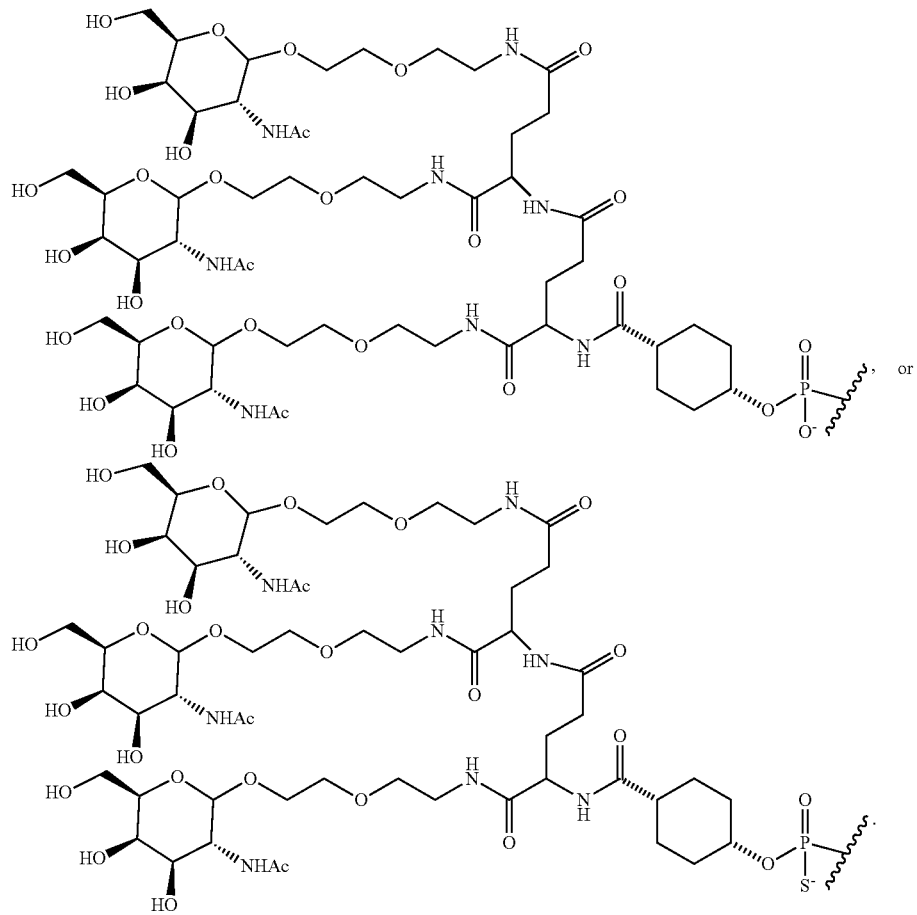

In some embodiments, a CFB RNAi agent disclosed herein includes an antisense strand that consists of, consists essentially of, or comprises a nucleobase sequence differing by 0 or 1 nucleobases from one of the following nucleotide sequences (5'→3'):

```
                                  (SEQ ID NO: 1275)
AAAGUACUCAGACACCACAGC;

(SEQ ID NO: 1283)
UAGAAACCCAAAUCCUCAUC;

(SEQ ID NO: 1332)
UAAGUACUCAGACACUACAGC;

(SEQ ID NO: 1333)
UAAGUACUCAGACACCAUAGC;

(SEQ ID NO: 1326)
UAAGUACUCAGACACCACAGC;

(SEQ ID NO: 1310)
UCAAUGACAGUAAUUGGGUCC;
```

-continued
```
                                  (SEQ ID NO: 359)
AAAGUACUCAGACACCACA;

(SEQ ID NO: 474)
UAGAAACCCAAAUCCUCA;

(SEQ ID NO: 367)
UAAGUACUCAGACACUACA;

(SEQ ID NO: 361)
UAAGUACUCAGACACCAUA;

(SEQ ID NO: 360)
UAAGUACUCAGACACCACA;
or
                                  (SEQ ID NO: 246)
UCAAUGACAGUAAUUGGGU.
```

In some embodiments, a CFB RNAi agent disclosed herein includes an antisense strand that consists of, consists essentially of, or comprises a nucleotide sequence differing by no more than 1 nucleotide from one of the following nucleotide sequences (5'→3'):

```
                         (SEQ ID NO: 1275)
AAAGUACUCAGACACCACAGC;

(SEQ ID NO: 1283)
UAGAAAACCCAAAUCCUCAUC;

(SEQ ID NO: 1332)
UAAGUACUCAGACACUACAGC;

(SEQ ID NO: 1333)
UAAGUACUCAGACACCAUAGC;

(SEQ ID NO: 1326)
UAAGUACUCAGACACCACAGC;

(SEQ ID NO: 1310)
UCAAUGACAGUAAUUGGGUCC;

(SEQ ID NO: 359)
AAAGUACUCAGACACCACA;

(SEQ ID NO: 474)
UAGAAAACCCAAAUCCUCA;

(SEQ ID NO: 367)
UAAGUACUCAGACACUACA;

(SEQ ID NO: 361)
UAAGUACUCAGACACCAUA;

(SEQ ID NO: 360)
UAAGUACUCAGACACCACA;
or
                         (SEQ ID NO: 246)
UCAAUGACAGUAAUUGGGU;
``` wherein all or substantially all of the nucleotides are modified nucleotides.

In some embodiments, a CFB RNAi agent disclosed herein includes an antisense strand that consists of, consists essentially of, or comprises a nucleobase sequence differing by 0 or 1 nucleobases from one of the following nucleotide sequences (5'→3'):

```
                         (SEQ ID NO: 1275)
AAAGUACUCAGACACCACAGC;

(SEQ ID NO: 1283)
UAGAAAACCCAAAUCCUCAUC;

(SEQ ID NO: 1332)
UAAGUACUCAGACACUACAGC;

(SEQ ID NO: 1333)
UAAGUACUCAGACACCAUAGC;

(SEQ ID NO: 1326)
UAAGUACUCAGACACCACAGC;

(SEQ ID NO: 1310)
UCAAUGACAGUAAUUGGGUCC;

(SEQ ID NO: 359)
AAAGUACUCAGACACCACA;

(SEQ ID NO: 474)
UAGAAAACCCAAAUCCUCA;

(SEQ ID NO: 367)
UAAGUACUCAGACACUACA;

(SEQ ID NO: 361)
UAAGUACUCAGACACCAUA;

(SEQ ID NO: 360)
UAAGUACUCAGACACCACA;
or
                         (SEQ ID NO: 246)
UCAAUGACAGUAAUUGGGU;
``` wherein the nucleotide sequence is located at positions 1-21 (5'→3') of the antisense strand.

In some embodiments, a CFB RNAi agent disclosed herein includes an antisense strand that consists of, consists essentially of, or comprises a nucleotide sequence that differs by 0 or 1 nucleotides from one of the following nucleotide sequences (5'→3'):

```
                         (SEQ ID NO: 1275)
AAAGUACUCAGACACCACAGC;

(SEQ ID NO: 1283)
UAGAAAACCCAAAUCCUCAUC;

(SEQ ID NO: 1332)
UAAGUACUCAGACACUACAGC;

(SEQ ID NO: 1333)
UAAGUACUCAGACACCAUAGC;

(SEQ ID NO: 1326)
UAAGUACUCAGACACCACAGC;

(SEQ ID NO: 1310)
UCAAUGACAGUAAUUGGGUCC;

(SEQ ID NO: 359)
AAAGUACUCAGACACCACA;

(SEQ ID NO: 474)
UAGAAAACCCAAAUCCUCA;

(SEQ ID NO: 367)
UAAGUACUCAGACACUACA;

(SEQ ID NO: 361)
UAAGUACUCAGACACCAUA;

(SEQ ID NO: 360)
UAAGUACUCAGACACCACA;
or
                         (SEQ ID NO: 246)
UCAAUGACAGUAAUUGGGU;
``` wherein the CFB RNAi agent further includes a sense strand that is at least partially complementary to the antisense strand; and wherein all or substantially all of the nucleotides on both the antisense strand and the sense strand are modified nucleotides.

In some embodiments, a CFB RNAi agent disclosed herein includes an antisense strand that consists of, consists essentially of, or comprises a nucleotide sequence that differs by 0 or 1 nucleotides from one of the following nucleotide sequences (5'→3'):

```
                         (SEQ ID NO: 1275)
AAAGUACUCAGACACCACAGC;

(SEQ ID NO: 1283)
UAGAAAACCCAAAUCCUCAUC;

(SEQ ID NO: 1332)
UAAGUACUCAGACACUACAGC;

(SEQ ID NO: 1333)
UAAGUACUCAGACACCAUAGC;
```

(SEQ ID NO: 1326)
UAAGUACUCAGACACCACAGC;

(SEQ ID NO: 1310)
UCAAUGACAGUAAUUGGGUCC;

(SEQ ID NO: 359)
AAAGUACUCAGACACCACA;

(SEQ ID NO: 474)
UAGAAAACCCAAAUCCUCA;

(SEQ ID NO: 367)
UAAGUACUCAGACACUACA;

(SEQ ID NO: 361)
UAAGUACUCAGACACCAUA;

(SEQ ID NO: 360)
UAAGUACUCAGACACCACA;
or (SEQ ID NO: 246)
UCAAUGACAGUAAUUGGGU;

wherein the CFB RNAi agent further includes a sense strand that is at least partially complementary to the antisense strand; wherein all or substantially all of the nucleotides on both the antisense strand and the sense strand are modified nucleotides; and wherein the sense strand further includes inverted abasic residues at the 3' terminal end and at the 5' end of the nucleotide sequence, and the sense strand also includes a targeting ligand that is covalently linked to the 5' terminal end, wherein the targeting ligand includes a compound having affinity for the asialoglycoprotein receptor, preferably wherein the targeting ligand comprises N-acetyl-galactosamine.

In some embodiments, a CFB RNAi agent disclosed herein includes an antisense strand that consists of, consists essentially of, or comprises a nucleotide sequence that differs by 0 or 1 nucleotides from one of the following nucleotide sequences (5'→3'):

(SEQ ID NO: 1275)
AAAGUACUCAGACACCACAGC;

(SEQ ID NO: 1283)
UAGAAAACCCAAAUCCUCAUC;

(SEQ ID NO: 1332)
UAAGUACUCAGACACUACAGC;

(SEQ ID NO: 1333)
UAAGUACUCAGACACCAUAGC;

(SEQ ID NO: 1326)
UAAGUACUCAGACACCACAGC;

(SEQ ID NO: 1310)
UCAAUGACAGUAAUUGGGUCC;

(SEQ ID NO: 359)
AAAGUACUCAGACACCACA;

(SEQ ID NO: 474)
UAGAAAACCCAAAUCCUCA;

(SEQ ID NO: 367)
UAAGUACUCAGACACUACA;

(SEQ ID NO: 361)
UAAGUACUCAGACACCAUA;

(SEQ ID NO: 360)
UAAGUACUCAGACACCACA;
or (SEQ ID NO: 246)
UCAAUGACAGUAAUUGGGU;

wherein the CFB RNAi agent further includes a sense strand that is at least partially complementary to the antisense strand; wherein all or substantially all of the nucleotides on both the antisense strand and the sense strand are modified nucleotides; and wherein the sense strand further includes inverted abasic residues at the 3' terminal end and at the 5' end of the nucleotide sequence, and the sense strand also includes a targeting ligand that is covalently linked to the 5' terminal end, wherein the targeting ligand includes a compound having affinity for the asialoglycoprotein receptor, preferably wherein the targeting ligand comprises N-acetyl-galactosamine; and wherein the respective antisense strand sequence is located at positions 1-21 of the antisense strand.

In some embodiments, a CFB RNAi agent disclosed herein includes an antisense strand and a sense strand, wherein the antisense strand and the sense strand consist of, consist essentially of, or comprise nucleotide sequences that differ by 0 or 1 nucleotides from one of the following nucleotide sequence (5'→3') pairs:

(SEQ ID NO: 1275)
AAAGUACUCAGACACCACAGC
and (SEQ ID NO: 1355)
GCUGUGGUGUCUGAGUACUUU;

(SEQ ID NO: 1283)
UAGAAAACCCAAAUCCUCAUC
and (SEQ ID NO: 1363)
GAUGAGGAUUUGGGUUUUCUA;

(SEQ ID NO: 1332)
UAAGUACUCAGACACUACAGC
and (SEQ ID NO: 1406)
GCUGUGGUGUCUGAGUACUUA;

(SEQ ID NO: 1333)
UAAGUACUCAGACACCAUAGC
and (SEQ ID NO: 1406)
GCUGUGGUGUCUGAGUACUUA;

(SEQ ID NO: 1326)
UAAGUACUCAGACACCACAGC
and (SEQ ID NO: 1409)
GCUGUGGUGUUUGAGUACUUA;

(SEQ ID NO: 1310)
UCAAUGACAGUAAUUGGGUCC
and (SEQ ID NO: 1390)
GGACCCAAUUACUGUCAUUGA;

-continued

AAAGUACUCAGACACCACA (SEQ ID NO: 359)
and

UGUGGUGUCUGAGUACUUU; (SEQ ID NO: 1410)

UAGAAAACCCAAAUCCUCA (SEQ ID NO: 474)
and

UGAGGAUUUGGGUUUUCUA; (SEQ ID NO: 1408)

UAAGUACUCAGACACUACA (SEQ ID NO: 367)
and

UGUGGUGUCUGAGUACUUA; (SEQ ID NO: 779)

UAAGUACUCAGACACCAUA (SEQ ID NO: 361)
and

UGUGGUGUCUGAGUACUUA; (SEQ ID NO: 779)
or

UAAGUACUCAGACACCACA (SEQ ID NO: 360)
and

UGUGGUGUUUGAGUACUUA (SEQ ID NO: 1439)

UCAAUGACAGUAAUUGGGU (SEQ ID NO: 246)
and

ACCCAAUUACUGUCAUUGA; (SEQ ID NO: 665)

wherein all or substantially all of the nucleotides on both the antisense strand and the sense strand are modified nucleotides.

In some embodiments, a CFB RNAi agent disclosed herein includes an antisense strand and a sense strand, wherein the antisense strand and the sense strand consist of, consist essentially of, or comprise nucleotide sequences that differ by 0 or 1 nucleotides from one of the following nucleotide sequences (5'→3') pairs:

AAAGUACUCAGACACCACAGC (SEQ ID NO: 1275)
and

GCUGUGGUGUCUGAGUACUUU; (SEQ ID NO: 1355)

UAGAAAACCCAAAUCCUCAUC (SEQ ID NO: 1283)
and

GAUGAGGAUUUGGGUUUUCUA; (SEQ ID NO: 1363)

UAAGUACUCAGACACUACAGC (SEQ ID NO: 1332)
and

GCUGUGGUGUCUGAGUACUUA; (SEQ ID NO: 1406)

UAAGUACUCAGACACCAUAGC (SEQ ID NO: 1333)
and

GCUGUGGUGUCUGAGUACUUA; (SEQ ID NO: 1406)

UAAGUACUCAGACACCACAGC (SEQ ID NO: 1326)
and

GCUGUGGUGUUUGAGUACUUA; (SEQ ID NO: 1409)

UCAAUGACAGUAAUUGGGUCC (SEQ ID NO: 1310)
and

GGACCCAAUUACUGUCAUUGA; (SEQ ID NO: 1390)

AAAGUACUCAGACACCACA (SEQ ID NO: 359)
and

UGUGGUGUCUGAGUACUUU; (SEQ ID NO: 1410)

UAGAAAACCCAAAUCCUCA (SEQ ID NO: 474)
and

UGAGGAUUUGGGUUUUCUA; (SEQ ID NO: 1408)

UAAGUACUCAGACACUACA (SEQ ID NO: 367)
and

UGUGGUGUCUGAGUACUUA; (SEQ ID NO: 779)

UAAGUACUCAGACACCAUA (SEQ ID NO: 361)
and

UGUGGUGUCUGAGUACUUA; (SEQ ID NO: 779)
or

UAAGUACUCAGACACCACA (SEQ ID NO: 360)
and

UGUGGUGUUUGAGUACUUA (SEQ ID NO: 1439)

UCAAUGACAGUAAUUGGGU (SEQ ID NO: 246)
and

ACCCAAUUACUGUCAUUGA; (SEQ ID NO: 665)

wherein all or substantially all of the nucleotides on both the antisense strand and the sense strand are modified nucleotides; and wherein the sense strand further includes inverted abasic residues at the 3' terminal end and at the 5' end of the nucleotide sequence, and the sense strand also includes a targeting ligand that is covalently linked to the 5' terminal end, wherein the targeting ligand includes a compound with affinity for the asialoglycoprotein receptor, preferably wherein the targeting ligand comprises N-acetyl-galactosamine.

In some embodiments, a CFB RNAi agent disclosed herein includes an antisense strand that consists of, consists essentially of, or comprises a modified nucleotide sequence differing by no more than 1 nucleotide from one of the following nucleotide sequences (5'→3'):

(SEQ ID NO: 983)
asAfsaguaCfucagAfcAfcCfacagsc;

(SEQ ID NO: 913)
usAfsgsAfaAfaCfcCfaAfaUfcCfuCfaUfsc;

(SEQ ID NO: 915)
usAfsgsaAfaacccaAfaUfcCfucausc;

(SEQ ID NO: 1013)
usAfsaguaCfucagAfcAfcUfacagsc;

(SEQ ID NO: 1014)
usAfsaguaCfucagAfcAfcCfauagsc;

(SEQ ID NO: 994)
usAfsaguaCfucagAfcAfcCfacagsc;
or (SEQ ID NO: 1022)
usCfsaaugAfcaguAfaUfuGfggucsc;

wherein a, c, g, and u represent 2'-O-methyl adenosine, cytidine, guanosine, and uridine, respectively; Af, Cf, Gf, and Uf represent 2'-fluoro adenosine, cytidine, guanosine, and uridine, respectively; and s represents a phosphorothioate linkage, and wherein the sense strand is at least substantially complementary to the antisense strand. As the person of ordinary skill in the art would clearly understand, the inclusion of a phosphorothioate linkage as shown in the modified nucleotide sequences disclosed herein replaces the phosphodiester linkage typically present in oligonucleotides.

In some embodiments, a CFB RNAi agent disclosed herein includes an antisense strand that consists of, consists essentially of, or comprises a modified nucleotide sequence differing by no more than 1 nucleotide from one of the following nucleotide sequences (5'→3'):

(SEQ ID NO: 983)
asAfsaguaCfucagAfcAfcCfacagsc;

(SEQ ID NO: 913)
usAfsgsAfaAfaCfcCfaAfaUfcCfuCfaUfsc;

(SEQ ID NO: 915)
usAfsgsaAfaacccaAfaUfcCfucausc;

(SEQ ID NO: 1013)
usAfsaguaCfucagAfcAfcUfacagsc;

(SEQ ID NO: 1014)
usAfsaguaCfucagAfcAfcCfauagsc;

(SEQ ID NO: 994)
usAfsaguaCfucagAfcAfcCfacagsc;
or (SEQ ID NO: 1022)
usCfsaaugAfcaguAfaUfuGfggucsc;

wherein a, c, g, and u represent 2'-O-methyl adenosine, cytidine, guanosine, and uridine, respectively; Af, Cf, Gf, and Uf represent 2'-fluoro adenosine, cytidine, guanosine, and uridine, respectively; and s represents a phosphorothioate linkage, and wherein the sense strand is at least substantially complementary to the antisense strand; and wherein all or substantially all of the nucleotides of the sense strand are modified nucleotides.

In some embodiments, a CFB RNAi agent disclosed herein includes an antisense strand that consists of, consists essentially of, or comprises a modified nucleotide sequence differing by no more than 1 nucleotide from one of the following nucleotide sequences (5'→3'):

(SEQ ID NO: 983)
asAfsaguaCfucagAfcAfcCfacagsc;

(SEQ ID NO: 913)
usAfsgsAfaAfaCfcCfaAfaUfcCfuCfaUfsc;

(SEQ ID NO: 915)
usAfsgsaAfaacccaAfaUfcCfucausc;

(SEQ ID NO: 1013)
usAfsaguaCfucagAfcAfcUfacagsc;

(SEQ ID NO: 1014)
usAfsaguaCfucagAfcAfcCfauagsc;

(SEQ ID NO: 994)
usAfsaguaCfucagAfcAfcCfacagsc; or (SEQ ID NO: 1022)
usCfsaaugAfcaguAfaUfuGfggucsc;

wherein the CFB RNAi agent further includes the sense strand that is at least partially complementary to the antisense strand; wherein all or substantially all of the nucleotides of the sense strand are modified nucleotides; wherein all or substantially all of the nucleotides on both the antisense strand and the sense strand are modified nucleotides; and wherein the sense strand further includes inverted abasic residues at the 3' terminal end and at the 5' end of the nucleotide sequence, and the sense strand also includes a targeting ligand that is covalently linked to the 5' terminal end, wherein the targeting ligand includes a compound with affinity for the asialoglycoprotein receptor, preferably wherein the targeting ligand comprises N-acetyl-galactosamine.

In some embodiments, a CFB RNAi agent disclosed herein includes an antisense strand and a sense strand that consists of, consists essentially of, or comprises one of the following nucleotide sequence pairs (5'→3'):

(SEQ ID NO: 983)
asAfsaguaCfucagAfcAfcCfacagsc and (SEQ ID NO: 1176)
gcugugguGfUfCfugaguacuuu;

(SEQ ID NO: 913)
usAfsgsAfaAfaCfcCfaAfaUfcCfuCfaUfsc and (SEQ ID NO: 1184)
gaugaggaUfUfUfggguuuucua;

(SEQ ID NO: 915)
usAfsgsaAfaacccaAfaUfcCfucausc and (SEQ ID NO: 1185)
gaugaggaUfuUfGfggguuuucua;

(SEQ ID NO: 1013)
usAfsaguaCfucagAfcAfcUfacagsc and (SEQ ID NO: 1235)
gcugugguGfUfCfugaguacuua;

-continued

```
                                      (SEQ ID NO: 1014)
usAfsaguaCfucagAfcAfcCfauagsc and (SEQ ID NO: 1235)
gcugugguGfUfCfugaguacuua;

(SEQ ID NO: 994)
usAfsaguaCfucagAfcAfcCfacagsc and (SEQ ID NO: 1248)
gcugugguGfUfUfugaguacuua; or (SEQ ID NO: 1022)
usCfsaaugAfcaguAfaUfuGfggucsc and (SEQ ID NO: 1251)
ggacccAfaUfuAfcugucauuga;
``` wherein a, c, g, and u represent 2'-O-methyl adenosine, cytidine, guanosine, and uridine, respectively; Af, Cf, Gf, and Uf represent 2'-fluoro adenosine, cytidine, guanosine, and uridine, respectively; and s represents a phosphorothioate linkage; and wherein the sense strand also includes a targeting ligand having affinity for the asialoglycoprotein receptor, preferably wherein the targeting ligand comprises N-acetyl-galactosamine, wherein the targeting ligand is optionally linked at the 5'-end of the sense strand.

In some embodiments, a CFB RNAi agent disclosed herein includes an antisense strand and a sense strand that consists of, consists essentially of, or comprises modified nucleotide sequences that differs by 0 or 1 nucleotides from one of the following sequence pairs (5'→3'): IDC-41 DNA

```
                                      (SEQ ID NO: 983)
asAfsaguaCfucagAfcAfcCfacagsc and (SEQ ID NO: 1077)
(NAG37)s(invAb)sgcugugguGfUfCfugaguacuuus(invAb);

(SEQ ID NO: 913)
usAfsgsAfaAfaCfcCfaAfaUfcCfuCfaUfsc and (SEQ ID NO: 1085)
(NAG37)s(invAb)sgaugaggaUfUfUfggguuuucuas(invAb);

(SEQ ID NO: 915)
usAfsgsaAfaacccaAfaUfcCfucausc and (SEQ ID NO: 1086)
(NAG37)s(invAb)sgaugaggaUfuUfGfggguuuucuas(invAb);

(SEQ ID NO: 1013)
usAfsaguaCfucagAfcAfcUfacagsc and (SEQ ID NO: 1136)
(NAG37)s(invAb)sgcugugguGfUfCfugaguacuuas(invAb);

(SEQ ID NO: 1014)
usAfsaguaCfucagAfcAfcCfauagsc and (SEQ ID NO: 1136)
(NAG37)s(invAb)sgcugugguGfUfCfugaguacuuas(invAb);

(SEQ ID NO: 994)
usAfsaguaCfucagAfcAfcCfacagsc and (SEQ ID NO: 1149)
(NAG37)s(invAb)sgcugugguGfUfUfugaguacuuas(invAb);
or (SEQ ID NO: 1022)
usCfsaaugAfcaguAfaUfuGfggucsc and (SEQ ID NO: 1152)
(NAG37)s(invAb)sggacccAfaUfuAfcugucauugas(invAb);
``` wherein a, c, g, and u represent 2'-O-methyl adenosine, cytidine, guanosine, and uridine, respectively; Af, Cf, Gf, and Uf represent 2'-fluoro adenosine, cytidine, guanosine, and uridine, respectively; (NAG37)s represents the tridentate N-acetyl-galactosamine hepatocyte cell targeting ligand with the chemical structure as shown in Table 6; (invAb) represents an inverted abasic deoxyribonucleotide (see also Table 6), and s represents a phosphorothioate linkage.

Also disclosed herein are compositions comprising the disclosed RNAi agents, wherein the compositions further comprise a pharmaceutically acceptable excipient.

Additionally, provided herein are methods for inhibiting expression of a CFB gene in a hepatocyte cell in a human subject in vivo, the methods comprising introducing into the subject an effective amount of the disclosed CFB RNAi agents or the disclosed compositions.

Further provided herein are methods of treating a CFB-related disease, disorder, or symptom, the methods comprising administering to a human subject in need thereof a therapeutically effective amount of the disclosed compositions.

In some embodiments, the disease is PNH, IgAN, C3G, AMD including early and/or intermediate AMD, aHUS, GA, IC-MPGN, LN, anti-GBM, RA, Doyne honeycomb retinal dystrophy, and/or other complement-mediated renal diseases.

In some embodiments, the RNAi agents are administered at a dose of about 0.05 mg/kg to about 6.0 mg/kg of body weight of the human subject. In some embodiments, the CFB RNAi agents disclosed herein are administered in a fixed dose of a single injection containing about 25 mg, about 50 mg, about 100 mg, about 200 mg, about 300 mg, or about 400 mg of CFB RNAi Agent.

Also provided herein are usages of the disclosed RNAi agents or the disclosed compositions, for the treatment of a disease, disorder, or symptom that is mediated at least in part by CFB gene expression.

Further provided herein are usages of the disclosed RNAi agents or the disclosed compositions, for the preparation of a pharmaceutical compositions for treating a disease, disorder, or symptom that is mediated at least in part by CFB gene expression.

DETAILED DESCRIPTION

Figure 1:
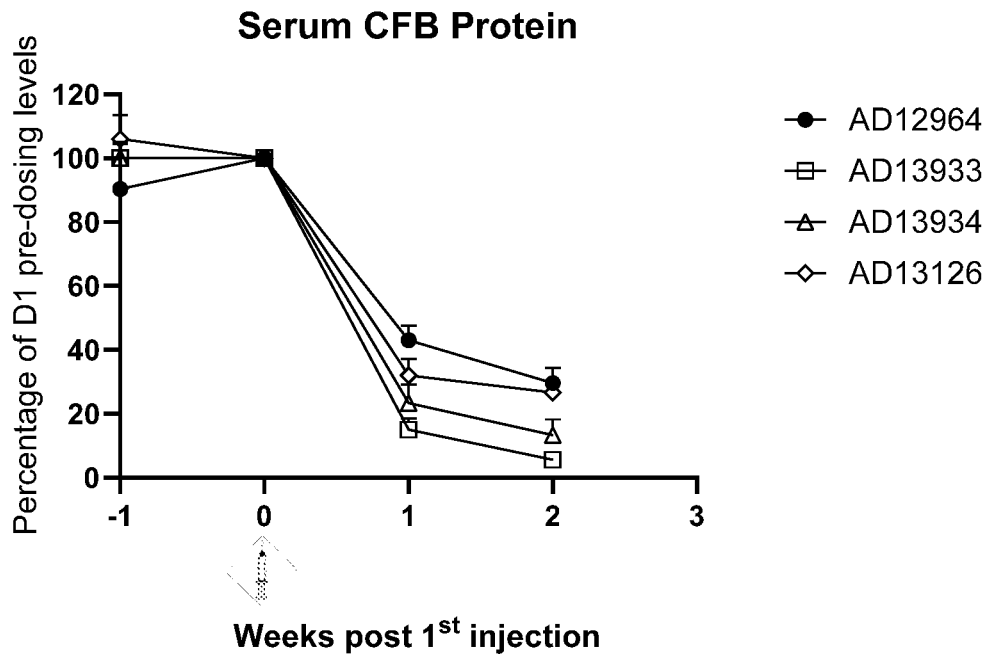
FIG. 1. Graph plotting relative serum cCFB protein levels normalized to pre-dose in cynomolgus monkeys. Syringes indicate the timing of injections. (See Example 12).

The disclosed CFB RNAi agents, compositions thereof, and methods of use may be understood more readily by reference to the following detailed description, which form a part of this disclosure. It is to be understood that the disclosure is not limited to what is specifically described and/or shown herein, and that the terminology used herein is for the purpose of describing particular embodiments by way of example only and is not intended to be limiting.

It is to be appreciated that while certain features of the disclosures included herein are, for clarity, described herein in the context of separate embodiments, they may also be provided in combination in a single embodiment. Conversely, various features of the disclosed methods that are, for brevity, described in the context of a single embodiment, may also be provided separately or in any subcombination.

Definitions

As used herein, an "RNAi agent" means a chemical composition of matter that contains an RNA or RNA-like (e.g., chemically modified RNA) oligonucleotide molecule that is capable of degrading or inhibiting (e.g., degrades or inhibits under appropriate conditions) translation of messenger RNA (mRNA) transcripts of a target mRNA in a sequence specific manner. As used herein, RNAi agents may operate through the RNA interference mechanism (i.e., inducing RNA interference through interaction with the RNA interference pathway machinery (RNA-induced silencing complex or RISC) of mammalian cells), or by any alternative mechanism(s) or pathway(s). While it is believed that RNAi agents, as that term is used herein, operate primarily through the RNA interference mechanism, the disclosed RNAi agents are not bound by or limited to any particular pathway or mechanism of action. RNAi agents disclosed herein are comprised of a sense strand and an antisense strand, and include, but are not limited to: short (or small) interfering RNAs (siRNAs), double stranded RNAs (dsRNA), micro RNAs (miRNAs), short hairpin RNAs (shRNA), and dicer substrates. The antisense strand of the RNAi agents described herein is at least partially complementary to the mRNA being targeted (i.e., CFB mRNA). RNAi agents can include one or more modified nucleotides and/or one or more non-phosphodiester linkages.

As used herein, the terms "silence," "reduce," "inhibit," "down-regulate," or "knockdown" when referring to expression of a given gene, mean that the expression of the gene, as measured by the level of RNA transcribed from the gene or the level of polypeptide, protein, or protein subunit translated from the mRNA in a cell, group of cells, tissue, organ, or subject in which the gene is transcribed, is reduced when the cell, group of cells, tissue, organ, or subject is treated with the RNAi agents described herein as compared to a second cell, group of cells, tissue, organ, or subject that has not or have not been so treated.

As used herein, the terms "sequence" and "nucleotide sequence" mean a succession or order of nucleobases or nucleotides, described with a succession of letters using standard nomenclature. A nucleic acid molecule can comprise unmodified and/or modified nucleotides. A nucleotide sequence can comprise unmodified and/or modified nucleotides.

As used herein, a "base," "nucleotide base," or "nucleobase," is a heterocyclic pyrimidine or purine compound that is a component of a nucleotide, and includes the primary purine bases adenine and guanine, and the primary pyrimidine bases cytosine, thymine, and uracil. A nucleobase may further be modified to include, without limitation, universal bases, hydrophobic bases, promiscuous bases, size-expanded bases, and fluorinated bases. (See, e.g., Modified Nucleosides in Biochemistry, Biotechnology and Medicine, Herdewijn, P. ed. Wiley-VCH, 2008). The synthesis of such modified nucleobases (including phosphoramidite compounds that include modified nucleobases) is known in the art.

As used herein, the term "nucleotide" has the same meaning as commonly understood in the art. Thus, the term "nucleotide" as used herein, refers to a glycoside comprising a sugar moiety, a base moiety and a covalently linked group (linkage group), such as a phosphate or phosphorothioate internucleoside linkage group, and covers both naturally occurring nucleotides, such as DNA or RNA, and non-naturally occurring nucleotides comprising modified sugar and/or base moieties, which are also referred to as nucleotide analogs herein. Herein, a single nucleotide can be referred to as a monomer or unit.

As used herein, and unless otherwise indicated, the term "complementary," when used to describe a first nucleobase or nucleotide sequence (e.g., RNAi agent sense strand or targeted mRNA) in relation to a second nucleobase or nucleotide sequence (e.g., RNAi agent antisense strand or a single-stranded antisense oligonucleotide), means the ability of an oligonucleotide or polynucleotide including the first nucleotide sequence to hybridize (form base pair hydrogen bonds under mammalian physiological conditions (or otherwise suitable in vivo or in vitro conditions)) and form a duplex or double helical structure under certain standard conditions with an oligonucleotide that includes the second nucleotide sequence. The person of ordinary skill in the art would be able to select the set of conditions most appropriate for a hybridization test. Complementary sequences include Watson-Crick base pairs or non-Watson-Crick base pairs and include natural or modified nucleotides or nucleotide mimics, at least to the extent that the above hybridization requirements are fulfilled. Sequence identity or complementarity is independent of modification. For example, a and Af, as defined herein, are complementary to U (or T) and identical to A for the purposes of determining identity or complementarity.

As used herein, "perfectly complementary" or "fully complementary" means that in a hybridized pair of nucleobase or nucleotide sequence molecules, all (100%) of the bases in a contiguous sequence of a first oligonucleotide will hybridize with the same number of bases in a contiguous sequence of a second oligonucleotide. The contiguous sequence may comprise all or a part of a first or second nucleotide sequence.

As used herein, "partially complementary" means that in a hybridized pair of nucleobase or nucleotide sequence molecules, at least 70%, but not all, of the bases in a contiguous sequence of a first oligonucleotide will hybridize with the same number of bases in a contiguous sequence of a second oligonucleotide. The contiguous sequence may comprise all or a part of a first or second nucleotide sequence.

As used herein, "substantially complementary" means that in a hybridized pair of nucleobase or nucleotide sequence molecules, at least 85%, but not all, of the bases in a contiguous sequence of a first oligonucleotide will hybridize with the same number of bases in a contiguous sequence of a second oligonucleotide. The contiguous sequence may comprise all or a part of a first or second nucleotide sequence.

As used herein, the terms "complementary," "fully complementary," "partially complementary," and "substantially complementary" are used with respect to the nucleobase or nucleotide matching between the sense strand and the antisense strand of an RNAi agent, or between the antisense strand of an RNAi agent and a sequence of an MUC5AC mRNA.

As used herein, the term "substantially identical" or "substantial identity," as applied to a nucleic acid sequence means the nucleotide sequence (or a portion of a nucleotide sequence) has at least about 85% sequence identity or more, e.g., at least 90%, at least 95%, or at least 99% identity, compared to a reference sequence. Percentage of sequence identity is determined by comparing two optimally aligned sequences over a comparison window. The percentage is calculated by determining the number of positions at which the same type of nucleic acid base occurs in both sequences to yield the number of matched positions, dividing the number of matched positions by the total number of positions in the window of comparison and multiplying the result by 100 to yield the percentage of sequence identity. The inventions disclosed herein encompass nucleotide sequences substantially identical to those disclosed herein.

As used herein, the terms "individual", "patient" and "subject", are used interchangeably to refer to a member of any animal species including, but not limited to, birds, humans and other primates, and other mammals including commercially relevant mammals or animal models such as mice, rats, monkeys, cattle, pigs, horses, sheep, cats, and dogs. Preferably, the subject is a human.

As used herein, the terms "treat," "treatment," and the like, mean the methods or steps taken to provide relief from or alleviation of the number, severity, and/or frequency of one or more symptoms of a disease in a subject. As used herein, "treat" and "treatment" may include the prevention, management, prophylactic treatment, and/or inhibition or reduction of the number, severity, and/or frequency of one or more symptoms of a disease in a subject.

As used herein, the phrase "introducing into a cell," when referring to an RNAi agent, means functionally delivering the RNAi agent into a cell. The phrase "functional delivery," means delivering the RNAi agent to the cell in a manner that enables the RNAi agent to have the expected biological activity, e.g., sequence-specific inhibition of gene expression.

Unless stated otherwise, use of the symbol  as used herein means that any group or groups may be linked thereto that is in accordance with the scope of the inventions described herein.

As used herein, the term "isomers" refers to compounds that have identical molecular formulae, but that differ in the nature or the sequence of bonding of their atoms or in the arrangement of their atoms in space. Isomers that differ in the arrangement of their atoms in space are termed "stereoisomers." Stereoisomers that are not mirror images of one another are termed "diastereoisomers," and stereoisomers that are non-superimposable mirror images are termed "enantiomers," or sometimes optical isomers. A carbon atom bonded to four non-identical substituents is termed a "chiral center."

As used herein, unless specifically identified in a structure as having a particular conformation, for each structure in which asymmetric centers are present and thus give rise to enantiomers, diastereomers, or other stereoisomeric configurations, each structure disclosed herein is intended to represent all such possible isomers, including their optically pure and racemic forms. For example, the structures disclosed herein are intended to cover mixtures of diastereomers as well as single stereoisomers.

As used in a claim herein, the phrase "consisting of" excludes any element, step, or ingredient not specified in the claim. When used in a claim herein, the phrase "consisting essentially of" limits the scope of a claim to the specified materials or steps and those that do not materially affect the basic and novel characteristic(s) of the claimed invention.

The person of ordinary skill in the art would readily understand and appreciate that the compounds and compositions disclosed herein may have certain atoms (e.g., N, O, or S atoms) in a protonated or deprotonated state, depending upon the environment in which the compound or composition is placed. Accordingly, as used herein, the structures disclosed herein envisage that certain functional groups, such as, for example, OH, SH, or NH, may be protonated or deprotonated. The disclosure herein is intended to cover the disclosed compounds and compositions regardless of their state of protonation based on the environment (such as pH), as would be readily understood by the person of ordinary skill in the art. Correspondingly, compounds described herein with labile protons or basic atoms should also be understood to represent salt forms of the corresponding compound. Compounds described herein may be in a free acid, free base, or salt form. Pharmaceutically acceptable salts of the compounds described herein should be understood to be within the scope of the invention.

As used herein, the term "linked" or "conjugated" when referring to the connection between two compounds or molecules means that two compounds or molecules are joined by a covalent bond. Unless stated, the terms "linked" and "conjugated" as used herein may refer to the connection between a first compound and a second compound either with or without any intervening atoms or groups of atoms.

As used herein, the term "including" is used to herein mean, and is used interchangeably with, the phrase "including but not limited to." The term "or" is used herein to mean, and is used interchangeably with, the term "and/or," unless the context clearly indicates otherwise.

Unless otherwise defined, all technical and scientific terms used herein have the same meaning as commonly understood by one of ordinary skill in the art. Although methods and materials similar or equivalent to those described herein can be used in the practice or testing of the present invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

Where a value is explicitly recited, it is to be understood that values which are about the same quantity or amount as the recited value are also within the scope of the disclosure. Where a combination is disclosed, each sub-combination of the elements of that combination is also specifically disclosed and is within the scope of the disclosure. Conversely, where different elements or groups of elements are individually disclosed, combinations thereof are also disclosed. Where any element of a disclosure is disclosed as having a plurality of alternatives, examples of that disclosure in which each alternative is excluded singly or in any combination with the other alternatives are also hereby disclosed; more than one element of a disclosure can have such exclusions, and all combinations of elements having such exclusions are hereby disclosed.

Other objects, features, aspects, and advantages of the invention will be apparent from the following detailed description, accompanying figures, and from the claims.

DETAILED DESCRIPTION

RNAi Agents

Described herein are RNAi agents for inhibiting expression of a CFB gene. Each CFB RNAi agent comprises a sense strand and an antisense strand. The sense strand can be 15 to 49 nucleotides in length. The antisense strand can be 18 to 30 nucleotides in length. The sense and antisense strands can be either the same length or they can be different lengths. In some embodiments, the sense and antisense strands are each independently 21 to 27 nucleotides in length. In some embodiments, both the sense and antisense strands are each 21-26 nucleotides in length. In some embodiments, the sense and antisense strands are each 21-24 nucleotides in length. In some embodiments, the sense strand is about 19 nucleotides in length while the antisense strand is about 21 nucleotides in length. In some embodiments, the sense strand is about 21 nucleotides in length while the antisense strand is about 23 nucleotides in length. In some embodiments, a sense strand is 23 nucleotides in length and an antisense strand is 21 nucleotides in length. In some embodiments, both the sense and antisense strands are each 21 nucleotides in length. In some embodiments, the RNAi agent antisense strands are each independently 18, 19, 20, 21, 22, 23, 24, 25, 26, 27, 28, 29, or 30 nucleotides in length. In some embodiments, the RNAi agent sense strands are each independently 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, or 49 nucleotides in length. The sense and antisense strands are annealed to form a duplex, and in some embodiments, a double-stranded RNAi agent has a duplex length of about 15, 16, 17, 18, 19, 20, 21, 22, 23, 24, 25, 26, 27, 28, 29, or 30 nucleotides.

Examples of nucleotide sequences used in forming CFB RNAi agents are provided in Tables 2, 3, 4A, 4B, or 5C. Examples of RNAi agent duplexes, that include the sense strand and antisense strand sequences in Tables 2, 3, 4A, 4B, or 5C, are shown in Tables 5A, 5B, or 5C.

In some embodiments, the region of perfect, substantial, or partial complementarity between the sense strand and the antisense strand is 15-26 (e.g., 15, 16, 17, 18, 19, 20, 21, 22, 23, 24, 25, or 26) nucleotides in length and occurs at or near the 5' end of the antisense strand (e.g., this region may be separated from the 5' end of the antisense strand by 0, 1, 2, 3, or 4 nucleotides that are not perfectly, substantially, or partially complementary).

A sense strand of the CFB RNAi agents described herein includes at least 15 consecutive nucleotides that have at least 85% identity to a core stretch sequence (also referred to herein as a "core stretch" or "core sequence") of the same number of nucleotides in a CFB mRNA. In some embodiments, a sense strand core stretch sequence is 100% (perfectly) complementary or at least about 85% (substantially) complementary to a core stretch sequence in the antisense strand, and thus the sense strand core stretch sequence is typically perfectly identical or at least about 85% identical to a nucleotide sequence of the same length (sometimes referred to, e.g., as a target sequence) present in the CFB mRNA target. In some embodiments, this sense strand core stretch is 15, 16, 17, 18, 19, 20, 21, 22, or 23 nucleotides in length. In some embodiments, this sense strand core stretch is 17 nucleotides in length. In some embodiments, this sense strand core stretch is 19 nucleotides in length. In some embodiments, this sense strand core stretch is 21 nucleotides in length.

An antisense strand of a CFB RNAi agent described herein includes at least 15 consecutive nucleotides that have at least 85% complementarity to a core stretch of the same number of nucleotides in a CFB mRNA and to a core stretch of the same number of nucleotides in the corresponding sense strand. In some embodiments, an antisense strand core stretch is 100% (perfectly) complementary or at least about 85% (substantially) complementary to a nucleotide sequence (e.g., target sequence) of the same length present in the CFB mRNA target. In some embodiments, this antisense strand core stretch is 15, 16, 17, 18, 19, 20, 21, 22, or 23 nucleotides in length. In some embodiments, this antisense strand core stretch is 21 nucleotides in length. In some embodiments, this antisense strand core stretch is 19 nucleotides in length. A sense strand core stretch sequence can be the same length as a corresponding antisense core sequence or it can be a different length.

The CFB RNAi agent sense and antisense strands anneal to form a duplex. A sense strand and an antisense strand of a CFB RNAi agent can be partially, substantially, or fully complementary to each other. Within the complementary duplex region, the sense strand core stretch sequence is at least 85% complementary or 100% complementary to the antisense core stretch sequence. In some embodiments, the sense strand core stretch sequence contains a sequence of at least 15, at least 16, at least 17, at least 18, at least 19, at least 20, at least 21, at least 22, at least 23, at least 24, or at least 25 nucleotides that is at least 85% or 100% complementary to a corresponding 15, 16, 17, 18, 19, 20, 21, 22, 23, 24, or 25 nucleotide sequence of the antisense strand core stretch sequence (i.e., the sense and antisense core stretch sequences of a CFB RNAi agent have a region of at least 15, at least 16, at least 17, at least 18, at least 19, at least 20, at least 21, at least 22, at least 23, at least 24, or at least 25 nucleotides that is at least 85% base paired or 100% base paired.)

In some embodiments, the antisense strand of a CFB RNAi agent disclosed herein differs by 0, 1, 2, or 3 nucleotides from any of the antisense strand sequences in Table 2, Table 3, or Table 5C. In some embodiments, the sense strand of a CFB RNAi agent disclosed herein differs by 0, 1, 2, or 3 nucleotides from any of the sense strand sequences in Table 2, Table 4A, Table 4B, or Table 5C.

In some embodiments, the sense strand and/or the antisense strand can optionally and independently contain an additional 1, 2, 3, 4, 5, or 6 nucleotides (extension) at the 3' end, the 5' end, or both the 3' and 5' ends of the core stretch sequences. The antisense strand additional nucleotides, if present, may or may not be complementary to the corresponding sequence in the CFB mRNA. The sense strand additional nucleotides, if present, may or may not be identical to the corresponding sequence in the CFB mRNA. The antisense strand additional nucleotides, if present, may or may not be complementary to the corresponding sense strand's additional nucleotides, if present.

As used herein, an extension comprises 1, 2, 3, 4, 5, or 6 nucleotides at the 5' and/or 3' end of the sense strand core stretch sequence and/or antisense strand core stretch sequence. The extension nucleotides on a sense strand may or may not be complementary to nucleotides, either core stretch sequence nucleotides or extension nucleotides, in the corresponding antisense strand. Conversely, the extension nucleotides on an antisense strand may or may not be complementary to nucleotides, either core stretch nucleotides or extension nucleotides, in the corresponding sense strand. In some embodiments, both the sense strand and the antisense strand of an RNAi agent contain 3' and 5' extensions. In some embodiments, one or more of the 3' extension nucleotides of one strand base pairs with one or more 5' extension nucleotides of the other strand. In other embodiments, one or more of 3' extension nucleotides of one strand do not base pair with one or more 5' extension nucleotides of the other strand. In some embodiments, a CFB RNAi agent has an antisense strand having a 3' extension and a sense strand having a 5' extension. In some embodiments, the extension nucleotide(s) are unpaired and form an overhang. As used herein and in the art, an "overhang" refers to an extension of a stretch of one or more unpaired nucleotides located at a terminal end of either the sense strand or the antisense strand that does not form part of the hybridized or duplexed portion of an RNAi agent disclosed herein.

In some embodiments, a CFB RNAi agent comprises an antisense strand having a 3' extension of 1, 2, 3, 4, 5, or 6 nucleotides in length. In other embodiments, a CFB RNAi agent comprises an antisense strand having a 3' extension of 1, 2, or 3 nucleotides in length. In some embodiments, one or more of the antisense strand extension nucleotides comprise nucleotides that are complementary to the corresponding CFB mRNA sequence. In some embodiments, one or more of the antisense strand extension nucleotides comprise nucleotides that are not complementary to the corresponding CFB mRNA sequence.

In some embodiments, a CFB RNAi agent comprises a sense strand having a 3' extension of 1, 2, 3, 4, or 5 nucleotides in length. In some embodiments, one or more of the sense strand extension nucleotides comprises adenosine, uracil, or thymidine nucleotides, AT dinucleotide, or nucleotides that correspond to or are the identical to nucleotides in the CFB mRNA sequence. In some embodiments, the 3' sense strand extension includes or consists of one of the following sequences, but is not limited to: T, UT, TT, UU, UUT, TTT, or TTTT (each listed 5' to 3').

A sense strand can have a 3' extension and/or a 5' extension. In some embodiments, a CFB RNAi agent comprises a sense strand having a 5' extension of 1, 2, 3, 4, 5, or 6 nucleotides in length. In some embodiments, one or more of the sense strand extension nucleotides comprise nucleotides that correspond to or are identical to nucleotides in the CFB mRNA sequence.

Examples of sequences used in forming CFB RNAi agents are provided in Tables 2, 3, 4A, 4B, or 5C. In some embodiments, a CFB RNAi agent antisense strand includes a sequence of any of the sequences in Tables 2, 3, or 5C. In certain embodiments, a CFB RNAi agent antisense strand comprises or consists of any one of the modified sequences in Table 3. In some embodiments, a CFB RNAi agent antisense strand includes the sequence of nucleotides (from 5' end→3' end) 1-17, 2-15, 2-17, 1-18, 2-18, 1-19, 2-19, 1-20, 2-20, 1-21, or 2-21, of any of the sequences in Tables 2, 3, or 5C. In some embodiments, a CFB RNAi agent sense strand includes the sequence of any of the sequences in Tables 2, 4A, 4B, or 5C. In some embodiments, a CFB RNAi agent sense strand includes the sequence of nucleotides (from 5' end→3' end) 1-18, 1-19, 1-20, 1-21, 2-19, 2-20, 2-21, 3-20, 3-21, or 4-21 of any of the sequences in Tables 2, 4A, 4B, or 5C. In certain embodiments, a CFB RNAi agent sense strand comprises or consists of a modified sequence of any one of the modified sequences in Table 4A or Table 4B.

In some embodiments, the sense and antisense strands of the RNAi agents described herein contain the same number of nucleotides. In some embodiments, the sense and antisense strands of the RNAi agents described herein contain different numbers of nucleotides. In some embodiments, the sense strand 5' end and the antisense strand 3' end of an RNAi agent form a blunt end. In some embodiments, the sense strand 3' end and the antisense strand 5' end of an RNAi agent form a blunt end. In some embodiments, both ends of an RNAi agent form blunt ends. In some embodiments, neither end of an RNAi agent is blunt-ended. As used herein a "blunt end" refers to an end of a double stranded RNAi agent in which the terminal nucleotides of the two annealed strands are complementary (form a complementary base-pair).

In some embodiments, the sense strand 5' end and the antisense strand 3' end of an RNAi agent form a frayed end. In some embodiments, the sense strand 3' end and the antisense strand 5' end of an RNAi agent form a frayed end. In some embodiments, both ends of an RNAi agent form a frayed end. In some embodiments, neither end of an RNAi agent is a frayed end. As used herein a frayed end refers to an end of a double stranded RNAi agent in which the terminal nucleotides of the two annealed strands from a pair (i.e., do not form an overhang) but are not complementary (i.e. form a non-complementary pair). In some embodiments, one or more unpaired nucleotides at the end of one strand of a double stranded RNAi agent form an overhang. The unpaired nucleotides may be on the sense strand or the antisense strand, creating either 3' or 5' overhangs. In some embodiments, the RNAi agent contains: a blunt end and a frayed end, a blunt end and 5' overhang end, a blunt end and a 3' overhang end, a frayed end and a 5' overhang end, a frayed end and a 3' overhang end, two 5' overhang ends, two 3' overhang ends, a 5' overhang end and a 3' overhang end, two frayed ends, or two blunt ends. Typically, when present, overhangs are located at the 3' terminal ends of the sense strand, the antisense strand, or both the sense strand and the antisense strand.

The CFB RNAi agents disclosed herein may also be comprised of one or more modified nucleotides. In some embodiments, substantially all of the nucleotides of the sense strand and substantially all of the nucleotides of the antisense strand of the CFB RNAi agent are modified nucleotides. The CFB RNAi agents disclosed herein may further be comprised of one or more modified internucleoside linkages, e.g., one or more phosphorothioate linkages. In some embodiments, a CFB RNAi agent contains one or more modified nucleotides and one or more modified internucleoside linkages. In some embodiments, a 2'-modified nucleotide is combined with modified internucleoside linkage.

In some embodiments, a CFB RNAi agent is prepared or provided as a salt, mixed salt, or a free-acid. In some embodiments, a CFB RNAi agent is prepared as a pharmaceutically acceptable salt. In some embodiments, a CFB RNAi agent is prepared as a pharmaceutically acceptable sodium salt. Such forms that are well known in the art are within the scope of the inventions disclosed herein.

Modified Nucleotides

Modified nucleotides, when used in various oligonucleotide constructs, can preserve activity of the compound in cells while at the same time increasing the serum stability of these compounds, and can also minimize the possibility of activating interferon activity in humans upon administering of the oligonucleotide construct.

In some embodiments, a CFB RNAi agent contains one or more modified nucleotides. As used herein, a "modified nucleotide" is a nucleotide other than a ribonucleotide (2'-hydroxyl nucleotide). In some embodiments, at least 50% (e.g., at least 60%, at least 70%, at least 80%, at least 90%, at least 95%, at least 97%, at least 98%, at least 99%, or 100%) of the nucleotides are modified nucleotides. As used herein, modified nucleotides can include, but are not limited to, deoxyribonucleotides, nucleotide mimics, abasic nucleotides, 2'-modified nucleotides, inverted nucleotides, modified nucleobase-comprising nucleotides, bridged nucleotides, peptide nucleic acids (PNAs), 2',3'-seco nucleotide mimics (unlocked nucleobase analogues), locked nucleotides, 3'-O-methoxy (2' internucleoside linked) nucleotides, 2'-F-Arabino nucleotides, 5'-Me, 2'-fluoro nucleotide, morpholine nucleotides, vinyl phosphonate deoxyribonucleotides, vinyl phosphonate containing nucleotides, and cyclopropyl phosphonate containing nucleotides. 2'-modified nucleotides (i.e., a nucleotide with a group other than a hydroxyl group at the 2' position of the five-membered sugar ring) include, but are not limited to, 2'-O-methyl nucleotides (also referred to herein or in the art as 2'-methoxy nucleotides), 2'-fluoro nucleotides (also referred to herein or in the art as 2'-deoxy-2'-fluoro nucleotides), 2'-deoxy nucleotides, 2'-methoxyethyl (2'-O-2-methoxylethyl) nucleotides (also referred herein or in the art as 2'-MOE nucleotides), 2'-amino nucleotides, and 2'-alkyl nucleotides. It is not necessary for all positions in a given compound to be uniformly modified. Conversely, more than one modification can be incorporated in a single CFB RNAi agent or even in a single nucleotide thereof. The CFB RNAi agent sense strands and antisense strands can be synthesized and/or modified by methods known in the art. Modification at one nucleotide is independent of modification at another nucleotide.

Modified nucleobases include synthetic and natural nucleobases, such as 5-substituted pyrimidines, 6-azapyrinidines and N-2, N-6 and 0-6 substituted purines, (e.g., 2-aminopropyladenine, 5-propynyluracil, or 5-propynylcytosine), 5-methylcytosine (5-me-C), 5-hydroxytnethyl cytosine, inosine, xanthine, hypoxanthine, 2-aminoadenine, 6-alkyl (e.g., 6-methyl, 6-ethyl, 6-isopropyl, or 6-n-butyl) derivatives of adenine and guanine, 2-alkyl (e.g., 2-methyl, 2-ethyl, 2-isopropyl, or 2-n-butyl) and other alkyl derivatives of adenine and guanine, 2-thiouracil, 2-thiothymine, 2-thiocytosine, 5-halouracil, cytosine, 5-propynyl uracil, 5-propynyl cytosine, 6-azo uracil, 6-azo cytosine, 6-azo thymine, 5-uracil (pseudouracil), 4-thiouracil, 8-halo, 8-amino, 8-sulfhydryl, 8-thioalkyl, 8-hydroxyl and other 8-substituted adenines and guanines, 5-halo (e.g., 5-bromo), 5-trifluoromethyl, and other 5-substituted uracils and cytosines, 7-methylguanine and 7-methyladenine, 8-azaguanine and 8-azaadenine, 7-deazaguanine, 7-deazaadenine, 3-deazaguanine, and 3-deazaadenine.

In some embodiments, the 5' and/or 3' end of the antisense strand can include abasic residues (Ab), which can also be referred to as an "abasic site" or "abasic nucleotide." An abasic residue (Ab) is a nucleotide or nucleoside that lacks a nucleobase at the 1' position of the sugar moiety. In some embodiments, an abasic residue can be placed internally in a nucleotide sequence. In some embodiments, Ab or AbAb can be added to the 3' end of the antisense strand. In some embodiments, the 5' end of the sense strand can include one or more additional abasic residues (e.g., (Ab) or (AbAb)). In some embodiments, UUAb, UAb, or Ab are added to the 3' end of the sense strand. In some embodiments, an abasic (deoxyribose) residue can be replaced with a ribitol (abasic ribose) residue.

In some embodiments, all or substantially all of the nucleotides of an RNAi agent are modified nucleotides. As used herein, an RNAi agent wherein substantially all of the nucleotides present are modified nucleotides is an RNAi agent having four or fewer (i.e., 0, 1, 2, 3, or 4) nucleotides in both the sense strand and the antisense strand being ribonucleotides (i.e., unmodified). As used herein, a sense strand wherein substantially all of the nucleotides present are modified nucleotides is a sense strand having two or fewer (i.e., 0, 1, or 2) nucleotides in the sense strand being unmodified ribonucleotides. As used herein, an antisense strand wherein substantially all of the nucleotides present are modified nucleotides is an antisense strand having two or fewer (i.e., 0, 1, or 2) nucleotides in the antisense strand being unmodified ribonucleotides. In some embodiments, one or more nucleotides of an RNAi agent is an unmodified ribonucleotide. Chemical structures for certain modified nucleotides are set forth in Table 6 herein.

Modified Internucleoside Linkages

In some embodiments, one or more nucleotides of a CFB RNAi agent are linked by non-standard linkages or backbones (i.e., modified internucleoside linkages or modified backbones). Modified internucleoside linkages or backbones include, but are not limited to, phosphorothioate groups (represented herein as a lower case "s"), chiral phosphorothioates, thiophosphates, phosphorodithioates, phosphotriesters, aminoalkyl-phosphotriesters, alkyl phosphonates (e.g., methyl phosphonates or 3'-alkylene phosphonates), chiral phosphonates, phosphinates, phosphoramidates (e.g., 3'-amino phosphoramidate, aminoalkylphosphoramidates, or thionophosphoramidates), thionoalkyl-phosphonates, thionoalkylphosphotriesters, morpholino linkages, boranophosphates having normal 3'-5' linkages, 2'-5' linked analogs of boranophosphates, or boranophosphates having inverted polarity wherein the adjacent pairs of nucleoside units are linked 3'-5' to 5'-3' or 2'-5' to 5'-2'. In some embodiments, a modified internucleoside linkage or backbone lacks a phosphorus atom. Modified internucleoside linkages lacking a phosphorus atom include, but are not limited to, short chain alkyl or cycloalkyl inter-sugar linkages, mixed heteroatom and alkyl or cycloalkyl inter-sugar linkages, or one or more short chain heteroatomic or heterocyclic inter-sugar linkages. In some embodiments, modified internucleoside backbones include, but are not limited to, siloxane backbones, sulfide backbones, sulfoxide backbones, sulfone backbones, formacetyl and thioformacetyl backbones, methylene formacetyl and thioformacetyl backbones, alkene-containing backbones, sulfamate backbones, methyleneimino and methylenehydrazino backbones, sulfonate and sulfonamide backbones, amide backbones, and other backbones having mixed N, O, S, and CH2 components.

In some embodiments, a sense strand of a CFB RNAi agent can contain 1, 2, 3, 4, 5, or 6 phosphorothioate linkages, an antisense strand of a CFB RNAi agent can contain 1, 2, 3, 4, 5, or 6 phosphorothioate linkages, or both the sense strand and the antisense strand independently can contain 1, 2, 3, 4, 5, or 6 phosphorothioate linkages. In some embodiments, a sense strand of a CFB RNAi agent can contain 1, 2, 3, or 4 phosphorothioate linkages, an antisense strand of a CFB RNAi agent can contain 1, 2, 3, or 4 phosphorothioate linkages, or both the sense strand and the antisense strand independently can contain 1, 2, 3, or 4 phosphorothioate linkages.

In some embodiments, a CFB RNAi agent sense strand contains at least two phosphorothioate internucleoside linkages. In some embodiments, the phosphorothioate internucleoside linkages are between the nucleotides at positions 1-3 from the 3' end of the sense strand. In some embodiments, one phosphorothioate internucleoside linkage is at the 5' end of the sense strand nucleotide sequence, and another phosphorothioate linkage is at the 3' end of the sense strand nucleotide sequence. In some embodiments, two phosphorothioate internucleoside linkages are located at the 5' end of the sense strand, and another phosphorothioate linkage is at the 3' end of the sense strand. In some embodiments, the sense strand does not include any phosphorothioate internucleoside linkages between the nucleotides, but contains one, two, or three phosphorothioate linkages between the terminal nucleotides on both the 5' and 3' ends and the optionally present inverted abasic residue terminal caps. In some embodiments, the targeting ligand is linked to the sense strand via a phosphorothioate linkage.

In some embodiments, a CFB RNAi agent antisense strand contains four phosphorothioate internucleoside linkages. In some embodiments, the four phosphorothioate internucleoside linkages are between the nucleotides at positions 1-3 from the 5' end of the antisense strand and between the nucleotides at positions 19-21, 20-22, 21-23, 22-24, 23-25, or 24-26 from the 5' end. In some embodiments, three phosphorothioate internucleoside linkages are located between positions 1-4 from the 5' end of the antisense strand, and a fourth phosphorothioate internucleoside linkage is located between positions 20-21 from the 5' end of the antisense strand. In some embodiments, a CFB RNAi agent contains at least three or four phosphorothioate internucleoside linkages in the antisense strand.

Capping Residues or Moieties

In some embodiments, the sense strand may include one or more capping residues or moieties, sometimes referred to in the art as a "cap," a "terminal cap," or a "capping residue." As used herein, a "capping residue" is a non-nucleotide compound or other moiety that can be incorporated at one or more termini of a nucleotide sequence of an RNAi agent disclosed herein. A capping residue can provide the RNAi agent, in some instances, with certain beneficial properties, such as, for example, protection against exonuclease degradation. In some embodiments, inverted abasic residues (invAb) (also referred to in the art as "inverted abasic sites") are added as capping residues. (See, e.g., F. Czauderna, *Nucleic Acids Res.*, 2003; 31(11), 2705-16; U.S. Pat. No. 5,998,203). Capping residues are generally known in the art, and include, for example, inverted abasic residues as well as carbon chains such as a terminal $CFBH_7$ (propyl), C6H13 (hexyl), or C12H25 (dodecyl) groups. In some embodiments, a capping residue is present at either the 5' terminal end, the 3' terminal end, or both the 5' and 3' terminal ends of the sense strand. In some embodiments, the 5' end and/or the 3' end of the sense strand may include more than one inverted abasic deoxyribose moiety as a capping residue.

In some embodiments, one or more inverted abasic residues (invAb) are added to the 3' end of the sense strand. In some embodiments, one or more inverted abasic residues (invAb) are added to the 5' end of the sense strand. In some embodiments, one or more inverted abasic residues or inverted abasic sites are inserted between the targeting ligand and the nucleotide sequence of the sense strand of the RNAi agent. In some embodiments, the inclusion of one or more inverted abasic residues or inverted abasic sites at or near the terminal end or terminal ends of the sense strand of an RNAi agent allows for enhanced activity or other desired properties of an RNAi agent.

In some embodiments, one or more inverted abasic residues (invAb) are added to the 5' end of the sense strand. In some embodiments, one or more inverted abasic residues can be inserted between the targeting ligand and the nucleotide sequence of the sense strand of the RNAi agent. The inverted abasic residues may be linked via phosphate, phosphorothioate (e.g., shown herein as (invAb)s)), or other internucleoside linkages. In some embodiments, the inclusion of one or more inverted abasic residues at or near the terminal end or terminal ends of the sense strand of an RNAi agent may allow for enhanced activity or other desired properties of an RNAi agent. In some embodiments, an inverted abasic (deoxyribose) residue can be replaced with an inverted ribitol (abasic ribose) residue. In some embodiments, the 3' end of the antisense strand core stretch sequence, or the 3' end of the antisense strand sequence, may include an inverted abasic residue. The chemical structures for inverted abasic deoxyribose residues are shown in Table 6 below.

CFB RNAi Agents

The CFB RNAi agents disclosed herein are designed to target specific positions on a CFB gene (e.g., SEQ ID NO:1).

```
NM_001710.6 Homo sapiens complement factor B (CFB), mRNA transcript
(SEQ ID NO: 1):
    1 gggaagggaa tgtgaccagg tctaggtctg gagtttcagc ttggacactg agccaagcag
   61 acaagcaaag caagccagga cacaccatcc tgccccaggc ccagcttctc tcctgccttc
  121 caacgccatg gggagcaatc tcagccccca actctgcctg atgcccttta tcttgggcct
  181 cttgtctgga ggtgtgacca ccactccatg gtctttggcc cggcccagg gatcctgctc
  241 tctggagggg gtagagatca aaggcggctc cttccgactt ctccaagagg gccaggcact
  301 ggagtacgtg tgtccttctg gcttctaccc gtaccctgtg cagacacgta cctgcagatc
  361 tacggggtcc tggagcaccc tgaagactca agaccaaaag actgtcagga aggcagagtg
  421 cagagcaatc cactgtccaa gaccacacga cttcgagaac ggggaatact ggccccggtc
  481 tccctactac aatgtgagtg atgagatctc tttccactgc tatgacggtt acactctccg
  541 gggctctgcc aatcgcacct gccaagtgaa tggccgatgg agtgggcaga cagcgatctg
  601 tgacaacgga gggggtact gctccaaccc gggcatcccc attggcacaa ggaaggtggg
  661 cagccagtac cgccttgaag acagcgtcac ctaccactgc agccgggggc ttaccctgcg
  721 tggctcccag cggcgaacgt gtcaggaagg tggctcttgg agcgggacgg agccttcctg
  781 ccaagactcc ttcatgtacg acacccctca agaggtggcc gaagctttcc tgtcttccct
  841 gacagagacc atagaaggag tcgatgctga ggatgggcac ggcccagggg aacaacagaa
  901 gcggaagatc gtcctggacc cttcaggctc catgaacatc tacctggtgc tagatggatc
  961 agacagcatt ggggccagca acttcacagg agccaaaaag tgtctagtca acttaattga
 1021 gaaggtggca agttatggtg tgaagccaag atatggtcta gtgacatatg ccacataccc
 1081 caaaatttgg gtcaaagtgt ctgaagcaga cagcagtaat gcagactggg tcacgaagca
 1141 gctcaatgaa atcaattatg aagaccacaa gttgaagtca gggactaaca ccaagaaggc
 1201 cctccaggca gtgtacagca tgatgagctg gccagatgac gtccctcctg aaggctggaa
 1261 ccgcacccgc catgtcatca tcctcatgac tgatggattg cacaacatgg gcggggaccc
 1321 aattactgtc attgatgaga tccgggactt gctatacatt ggcaaggatc gcaaaaaccc
 1381 aagggaggat tatctggatg tctatgtgtt tgggggtcggg cctttggtga accaagtgaa
 1441 catcaatgct ttggcttcca agaaagacaa tgagcaacat gtgttcaaag tcaaggatat
 1501 ggaaaacctg gaagatgttt tctaccaaat gatcgatgaa agccagtctc tgagtctctg
 1561 tggcatggtt tgggaacaca ggaagggtac cgattaccac aagcaaccat ggcaggccaa
 1621 gatctcagtc attcgcccctt caaagggaca cgagagctgt atgggggctg tggtgtctga
 1681 gtactttgtg ctgacagcag cacattgttt cactgtggat gacaaggaac actcaatcaa
 1741 ggtcagcgta ggaggggaga gcgggacct ggagatagaa gtagtcctat ttcaccccaa
 1801 ctacaacatt aatgggaaaa agaagcagg aattcctgaa ttttatgact atgacgttgc
 1861 cctgatcaag ctcaagaata agctgaaata tggccagact atcaggccca tttgtctccc
 1921 ctgcaccgag gaacaactc gagctttgag gcttcctcca actaccactt gccagcaaca
 1981 aaaggaagag ctgctccctg cacaggatat caaagctctg tttgtgtctg aggaggaa
```

```
2041  aaagctgact cggaaggagg tctacatcaa gaatggggat aagaaaggca gctgtgagag 2101  agatgctcaa tatgccccag gctatgacaa agtcaaggac atctcagagg tggtcacccc 2161  tcggttcctt tgtactggag gagtgagtcc ctatgctgac cccaatactt gcagaggtga 2221  ttctggcggc cccttgatag ttcacaagag aagtcgtttc attcaagttg gtgtaatcag 2281  ctggggagta gtggatgtct gcaaaaacca gaagcggcaa aagcaggtac ctgctcacgc 2341  ccgagacttt cacatcaacc tctttcaagt gctgccctgg ctgaaggaga aactccaaga 2401  tgaggatttg ggttttctat aaggggtttc ctgctggaca ggggcgtggg attgaattaa 2461  aacagctgcg acaaca
```

As defined herein, an antisense strand sequence is designed to target a CFB gene at a given position on the gene when the 5' terminal nucleobase of the antisense strand is aligned with a position that is 21 nucleotides downstream (towards the 3' end) from the position on the gene when base pairing to the gene. For example, as illustrated in Tables 1 and 2 herein, an antisense strand sequence designed to target a CFB gene at position 1667 requires that when base pairing to the gene, the 5' terminal nucleobase of the antisense strand is aligned with position 1687 of the CFB gene.

As provided herein, a CFB RNAi agent does not require that the nucleobase at position 1 (5'→3') of the antisense strand be complementary to the gene, provided that there is at least 85% complementarity (e.g., at least 85, 86, 87, 88, 89, 90, 91, 92, 93, 94, 95, 96, 97, 98, 99, or 100% complementarity) of the antisense strand and the gene across a core stretch sequence of at least 15 consecutive nucleotides. For example, for a CFB RNAi agent disclosed herein that is designed to target position 307 of a CFB gene, the 5' terminal nucleobase of the antisense strand of the of the CFB RNAi agent must be aligned with position 325 of the gene; however, the 5' terminal nucleobase of the antisense strand may be, but is not required to be, complementary to position 325 of a CFB gene, provided that there is at least 85% complementarity (e.g., at least 85, 86, 87, 88, 89, 90, 91, 92, 93, 94, 95, 96, 97, 98, 99, or 100% complementarity) of the antisense strand and the gene across a core stretch sequence of at least 15 consecutive nucleotides. As shown by, among other things, the examples disclosed herein and as is well known in the art, the specific site of binding of the gene by the antisense strand of the CFB RNAi agent (e.g., whether the CFB RNAi agent is designed to target a CFB gene at position 325, position 1667, position 2399, or at some other position) is important to the level of inhibition achieved by the CFB RNAi agent as well as the toxicity profile achieved by the molecule. (See, e.g., Kamola et al., *PLOS Computational Biology* 2015; 11(12), FIG. 1).

In some embodiments, the CFB RNAi agents disclosed herein target a CFB gene at or near the positions of the CFB gene sequence shown in Table 1. In some embodiments, the antisense strand of a CFB RNAi agent disclosed herein includes a core stretch sequence that is fully, substantially, or at least partially complementary to a target CFB 19-mer sequence disclosed in Table 1.

TABLE 1

CFB 19-mer mRNA Target Sequences (taken from *homo sapiens* complement factor B (CFB), mRNA, GenBank NM_001710.6 (SEQ ID NO: 1))

| SEQ ID No. | CFB 19-mer Target Sequences (5' → 3') | Corresponding Positions of Sequence on SEQ ID NO: 1 | Targeted Gene Position (as referred to herein) |
|---|---|---|---|
| 2 | CGUGUGUCCUUCUGGCUUC | 307-325 | 305 |
| 3 | UGAGUGAUGAGAUCUCUUU | 495-513 | 493 |
| 4 | AGUGAUGAGAUCUCUUUCC | 497-515 | 495 |
| 5 | CUGCUAUGACGGUUACACU | 517-535 | 515 |
| 6 | GCCAAGACUCCUUCAUGUA | 780-798 | 778 |
| 7 | AAGACUCCUUCAUGUACGA | 783-801 | 781 |
| 8 | ACUCCUUCAUGUACGACAC | 786-804 | 784 |
| 9 | GACCAUAGAAGGAGUCGAU | 847-865 | 845 |
| 10 | UCCAUGAACAUCUACCUGG | 929-947 | 927 |
| 11 | ACAUCUACCUGGUGCUAGA | 936-954 | 934 |
| 12 | AUCUACCUGGUGCUAGAUG | 938-956 | 936 |
| 13 | UCUACCUGGUGCUAGAUGG | 939-957 | 937 |

TABLE 1-continued

CFB 19-mer mRNA Target Sequences (taken from *homo sapiens* complement factor B (CFB), mRNA, GenBank NM_001710.6 (SEQ ID NO: 1))

| SEQ ID No. | CFB 19-mer Target Sequences (5' → 3') | Corresponding Positions of Sequence on SEQ ID NO: 1 | Targeted Gene Position (as referred to herein) |
|---|---|---|---|
| 14 | CUACCUGGUGCUAGAUGGA | 940-958 | 938 |
| 15 | UACCUGGUGCUAGAUGGAU | 941-959 | 939 |
| 16 | CCUGGUGCUAGAUGGAUCA | 943-961 | 941 |
| 17 | GUGCUAGAUGGAUCAGACA | 947-965 | 945 |
| 18 | UAGAUGGAUCAGACAGCAU | 951-969 | 949 |
| 19 | GGAUCAGACAGCAUUGGGG | 956-974 | 954 |
| 20 | GCCAAAAGUGUCUAGUCA | 992-1010 | 990 |
| 21 | CAAAAGUGUCUAGUCAAC | 994-1012 | 992 |
| 22 | AAAAGUGUCUAGUCAACUU | 996-1014 | 994 |
| 23 | GAAGGUGGCAAGUUAUGGU | 1021-1039 | 1019 |
| 24 | AAGGUGGCAAGUUAUGGUG | 1022-1040 | 1020 |
| 25 | GUUAUGGUGUGAAGCCAAG | 1032-1050 | 1030 |
| 26 | GCAGUGUACAGCAUGAUGA | 1208-1226 | 1206 |
| 27 | GAUGGAUUGCACAACAUGG | 1292-1310 | 1290 |
| 28 | ACCCAAUUACUGUCAUUGA | 1317-1335 | 1315 |
| 29 | CCCAAUUACUGUCAUUGAU | 1316-1334 | 1316 |
| 30 | CAAUUACUGUCAUUGAUGA | 1320-1338 | 1318 |
| 31 | CUGUCAUUGAUGAGAUCCG | 1326-1344 | 1324 |
| 32 | AGGAUUAUCUGGAUGUCUA | 1386-1404 | 1384 |
| 33 | UCUGGAUGUCUAUGUGUUU | 1393-1411 | 1391 |
| 34 | UGGAUGUCUAUGUGUUUGG | 1395-1413 | 1393 |
| 35 | ACCAAGUGAACAUCAAUGC | 1431-1449 | 1429 |
| 36 | AAGUGAACAUCAAUGCUUU | 1434-1452 | 1432 |
| 37 | GAACAUCAAUGCUUUGGCU | 1438-1456 | 1436 |
| 38 | ACAUCAAUGCUUUGGCUUC | 1440-1458 | 1438 |
| 39 | AGAAAGACAAUGAGCAACA | 1461-1479 | 1459 |
| 40 | AAGACAAUGAGCAACAUGU | 1464-1482 | 1462 |
| 41 | UCUGAGUCUCUGUGGCAUG | 1549-1567 | 1547 |
| 42 | UACCGAUUACCACAAGCAA | 1588-1606 | 1586 |
| 43 | CCGAUUACCACAAGCAACC | 1590-1608 | 1588 |
| 44 | UGGCAGGCCAAGAUCUCAG | 1610-1628 | 1608 |
| 45 | UGUGGUGUCUGAGUACUUU | 1669-1687 | 1667 |
| 46 | UGUCUGAGUACUUUGUGCU | 1674-1692 | 1672 |
| 47 | GUCUGAGUACUUUGUGCUG | 1675-1693 | 1673 |
| 48 | UGACAGCAGCACAUUGUUU | 1692-1710 | 1690 |
| 49 | GACGUUGCCCUGAUCAAGC | 1853-1871 | 1851 |

TABLE 1-continued

CFB 19-mer mRNA Target Sequences (taken from *homo sapiens* complement factor B (CFB), mRNA, GenBank NM_001710.6 (SEQ ID NO: 1))

| SEQ ID No. | CFB 19-mer Target Sequences (5' → 3') | Corresponding Positions of Sequence on SEQ ID NO: 1 | Targeted Gene Position (as referred to herein) |
|---|---|---|---|
| 50 | ACGUUGCCCUGAUCAAGCU | 1854-1872 | 1852 |
| 51 | UUUCAUUCAAGUUGGUGUA | 2257-2275 | 2255 |
| 52 | AAUCAGCUGGGGAGUAGUG | 2275-2293 | 2273 |
| 53 | UCAGCUGGGGAGUAGUGGA | 2277-2295 | 2275 |
| 54 | CUGGGGAGUAGUGGAUGUC | 2281-2299 | 2279 |
| 55 | GGGGAGUAGUGGAUGUCUG | 2283-2301 | 2281 |
| 56 | CAAGAUGAGGAUUUGGGUU | 2396-2414 | 2394 |
| 57 | AAGAUGAGGAUUUGGGUUU | 2397-2415 | 2395 |
| 58 | UGAGGAUUUGGGUUUUCUA | 2401-2419 | 2399 |

In some embodiments, a CFB RNAi agent includes an antisense strand wherein position 19 of the antisense strand (5'→3') is capable of forming a base pair with position 1 of a 19-mer target sequence disclosed in Table 1. In some embodiments, a CFB RNAi agent includes an antisense strand wherein position 1 of the antisense strand (5'→3') is capable of forming a base pair with position 19 of the 19-mer target sequence disclosed in Table 1.

In some embodiments, a CFB RNAi agent includes an antisense strand wherein position 2 of the antisense strand (5'→3') is capable of forming a base pair with position 18 of the 19-mer target sequence disclosed in Table 1. In some embodiments, a CFB RNAi agent includes an antisense strand wherein positions 2 through 18 of the antisense strand (5'→3') are capable of forming base pairs with each of the respective complementary bases located at positions 18 through 2 of the 19-mer target sequence disclosed in Table 1.

For the RNAi agents disclosed herein, the nucleotide at position 1 of the antisense strand (from 5' end→3' end) can be perfectly complementary to the CFB gene, or can be non-complementary to the CFB gene. In some embodiments, the nucleotide at position 1 of the antisense strand (from 5' end→3' end) is a U, A, or dT. In some embodiments, the nucleotide at position 1 of the antisense strand (from 5' end→3' end) forms an A:U or U:A base pair with the sense strand.

In some embodiments, a CFB RNAi agent antisense strand comprises the sequence of nucleotides (from 5' end→3' end) 2-18, 2-19, 2-20, or 2-21 of any of the antisense strand sequences in Table 2, Table 3, or Table 5C. In some embodiments, a CFB RNAi sense strand comprises the sequence of nucleotides (from 5' end→3' end) 3-21, 2-21, 1-21, 3-20, 2-20, 1-20, 3-19, 2-19, 1-19, 3-18, 2-18, or 1-18 of any of the sense strand sequences in Table 2, Table 4A, Table 4B, or Table 5C.

In some embodiments, a CFB RNAi agent antisense strand comprises the sequence of nucleotides (from 5' end→3' end) 2-18, 2-19, 2-20, or 2-21 of any of the antisense strand sequences of Table 2, Table 3, or Table 5C. In some embodiments, a CFB RNAi sense strand comprises the sequence of nucleotides (from 5' end→3' end) 3-21, 2-21, 1-21, 3-20, 2-20, 1-20, 3-19, 2-19, 1-19, 3-18, 2-18, or 1-18 of any of the sense strand sequences of Table 2, Table 4A, Table 4B, or Table 5C.

In some embodiments, a CFB RNAi agent is comprised of (i) an antisense strand comprising the sequence of nucleotides (from 5' end→3' end) 2-18 or 2-19 of any of the antisense strand sequences in Table 2 or Table 3, and (ii) a sense strand comprising the sequence of nucleotides (from 5' end→3' end) 3-21, 2-21, 1-21, 3-20, 2-20, 1-20, 3-19, 2-19, 1-19, 3-18, 2-18, or 1-18 of any of the sense strand sequences in Table 2 or Table 4A or Table 4B.

In some embodiments, a CFB RNAi agent is comprised of (i) an antisense strand comprising the sequence of nucleotides (from 5' end→3' end) 2-18 or 2-19 of any of the antisense strand sequences of Table 2 or Table 3, and (ii) a sense strand comprising the sequence of nucleotides (from 5' end→3' end) 3-21, 2-21, 1-21, 3-20, 2-20, 1-20, 3-19, 2-19, 1-19, 3-18, 2-18, or 1-18 of any of the sense strand sequences of Table 2 or Table 4A or Table 4B.

In some embodiments, the CFB RNAi agents include core 19-mer nucleotide sequences shown in the following Table 2.

TABLE 2

CFB RNAi Agent Antisense Strand and Sense Strand Core Stretch Base Sequences
(N = any nucleobase;)

| SEQ ID No. | Antisense Strand Base Sequence (5' → 3') (Shown as an Unmodified Nucleotide Sequence) | SEQ ID No. | Sense Strand Base Sequence (5' → 3') (Shown as an Unmodified Nucleotide Sequence) | Corresponding Positions of Identified Sequence on SEQ ID NO: 1 | Targeted Gene Position |
|---|---|---|---|---|---|
| 59 | GAAGCCAGAAGGACACACG | 478 | CGUGUGUCCUUCUGGCUUC | 307-325 | 305 |
| 60 | UAAGCCAGAAGGACACACG | 479 | CGUGUGUCCUUCUGGCUUA | 307-325 | 305 |
| 61 | NAAGCCAGAAGGACACACG | 480 | CGUGUGUCCUUCUGGCUUN | 307-325 | 305 |
| 62 | UAAGCCAGAAGGACACACN | 481 | NGUGUGUCCUUCUGGCUUA | 307-325 | 305 |
| 63 | NAAGCCAGAAGGACACACN | 482 | NGUGUGUCCUUCUGGCUUN | 307-325 | 305 |
| 64 | GAAGCCAGAAGGACACACG | 483 | CGUGUGUCCUUCUGICUUC | 307-325 | 305 |
| 65 | UAAGCCAGAAGGACACACG | 484 | CGUGUGUCCUUCUGICUUA | 307-325 | 305 |
| 66 | NAAGCCAGAAGGACACACG | 485 | CGUGUGUCCUUCUGICUUN | 307-325 | 305 |
| 67 | UAAGCCAGAAGGACACACN | 486 | NGUGUGUCCUUCUGICUUA | 307-325 | 305 |
| 68 | NAAGCCAGAAGGACACACN | 487 | NGUGUGUCCUUCUGICUUN | 307-325 | 305 |
| 69 | AAAGAGAUCUCAUCACUCA | 488 | UGAGUGAUGAGAUCUCUUU | 495-513 | 493 |
| 70 | UAAGAGAUCUCAUCACUCA | 489 | UGAGUGAUGAGAUCUCUUA | 495-513 | 493 |
| 71 | NAAGAGAUCUCAUCACUCA | 490 | UGAGUGAUGAGAUCUCUUN | 495-513 | 493 |
| 72 | AAAGAGAUCUCAUCACUCN | 491 | NGAGUGAUGAGAUCUCUUU | 495-513 | 493 |
| 73 | UAAGAGAUCUCAUCACUCN | 492 | NGAGUGAUGAGAUCUCUUA | 495-513 | 493 |
| 74 | NAAGAGAUCUCAUCACUCN | 493 | NGAGUGAUGAGAUCUCUUN | 495-513 | 493 |
| 75 | GGAAAGAGAUCUCAUCACU | 494 | AGUGAUGAGAUCUCUUUCC | 497-515 | 495 |
| 76 | UGAAAGAGAUCUCAUCACU | 495 | AGUGAUGAGAUCUCUUUCA | 497-515 | 495 |
| 77 | NGAAAGAGAUCUCAUCACU | 496 | AGUGAUGAGAUCUCUUUCN | 497-515 | 495 |
| 78 | UGAAAGAGAUCUCAUCACN | 497 | NGUGAUGAGAUCUCUUUCA | 497-515 | 495 |
| 79 | NGAAAGAGAUCUCAUCACN | 498 | NGUGAUGAGAUCUCUUUCN | 497-515 | 495 |
| 80 | AGUGUAACCGUCAUAGCAG | 499 | CUGCUAUGACGGUUACACU | 517-535 | 515 |
| 81 | UGUGUAACCGUCAUAGCAG | 500 | CUGCUAUGACGGUUACACA | 517-535 | 515 |
| 82 | NGUGUAACCGUCAUAGCAG | 501 | CUGCUAUGACGGUUACACN | 517-535 | 515 |
| 83 | AGUGUAACCGUCAUAGCAN | 502 | NUGCUAUGACGGUUACACU | 517-535 | 515 |
| 84 | UGUGUAACCGUCAUAGCAN | 503 | NUGCUAUGACGGUUACACA | 517-535 | 515 |
| 85 | NGUGUAACCGUCAUAGCAN | 504 | NUGCUAUGACGGUUACACN | 517-535 | 515 |
| 86 | UACAUGAAGGAGUCUUGGC | 505 | GCCAAGACUCCUUCAUGUA | 780-798 | 778 |
| 87 | NACAUGAAGGAGUCUUGGC | 506 | GCCAAGACUCCUUCAUGUN | 780-798 | 778 |
| 88 | UACAUGAAGGAGUCUUGGN | 507 | NCCAAGACUCCUUCAUGUA | 780-798 | 778 |
| 89 | NACAUGAAGGAGUCUUGGN | 508 | NCCAAGACUCCUUCAUGUN | 780-798 | 778 |
| 90 | UCGUACAUGAAGGAGUCUU | 509 | AAGACUCCUUCAUGUACGA | 783-801 | 781 |
| 91 | NCGUACAUGAAGGAGUCUU | 510 | AAGACUCCUUCAUGUACGN | 783-801 | 781 |
| 92 | UCGUACAUGAAGGAGUCUN | 511 | NAGACUCCUUCAUGUACGA | 783-801 | 781 |
| 93 | NCGUACAUGAAGGAGUCUN | 512 | NAGACUCCUUCAUGUACGN | 783-801 | 781 |
| 94 | UCGUACAUGAAGGAGUCUU | 513 | AAGACUCCUUCAUGUACIA | 783-801 | 781 |

TABLE 2-continued

CFB RNAi Agent Antisense Strand and Sense Strand Core Stretch Base Sequences
(N = any nucleobase;)

| SEQ ID No. | Antisense Strand Base Sequence (5' → 3') (Shown as an Unmodified Nucleotide Sequence) | SEQ ID No. | Sense Strand Base Sequence (5' → 3') (Shown as an Unmodified Nucleotide Sequence) | Corresponding Positions of Identified Sequence on SEQ ID NO: 1 | Targeted Gene Position |
|---|---|---|---|---|---|
| 95 | NCGUACAUGAAGGAGUCUU | 514 | AAGACUCCUUCAUGUACIN | 783-801 | 781 |
| 96 | UCGUACAUGAAGGAGUCUN | 515 | NAGACUCCUUCAUGUACIA | 783-801 | 781 |
| 97 | NCGUACAUGAAGGAGUCUN | 516 | NAGACUCCUUCAUGUACIN | 783-801 | 781 |
| 98 | GUGUCGUACAUGAAGGAGU | 517 | ACUCCUUCAUGUACGACAC | 786-804 | 784 |
| 99 | UUGUCGUACAUGAAGGAGU | 518 | ACUCCUUCAUGUACGACAA | 786-804 | 784 |
| 100 | NUGUCGUACAUGAAGGAGU | 519 | ACUCCUUCAUGUACGACAN | 786-804 | 784 |
| 101 | UUGUCGUACAUGAAGGAGN | 520 | NCUCCUUCAUGUACGACAA | 786-804 | 784 |
| 102 | NUGUCGUACAUGAAGGAGN | 521 | NCUCCUUCAUGUACGACAN | 786-804 | 784 |
| 103 | GUGUCGUACAUGAAGGAGU | 522 | ACUCCUUCAUGUACIACAC | 786-804 | 784 |
| 104 | UUGUCGUACAUGAAGGAGU | 523 | ACUCCUUCAUGUACIACAA | 786-804 | 784 |
| 105 | NUGUCGUACAUGAAGGAGU | 524 | ACUCCUUCAUGUACIACAN | 786-804 | 784 |
| 106 | UUGUCGUACAUGAAGGAGN | 525 | NCUCCUUCAUGUACIACAA | 786-804 | 784 |
| 107 | NUGUCGUACAUGAAGGAGN | 526 | NCUCCUUCAUGUACIACAN | 786-804 | 784 |
| 108 | AUCGACUCCUUCUAUGGUC | 527 | GACCAUAGAAGGAGUCGAU | 847-865 | 845 |
| 109 | UUCGACUCCUUCUAUGGUC | 528 | GACCAUAGAAGGAGUCGAA | 847-865 | 845 |
| 110 | NUCGACUCCUUCUAUGGUC | 529 | GACCAUAGAAGGAGUCGAN | 847-865 | 845 |
| 111 | AUCGACUCCUUCUAUGGUN | 530 | NACCAUAGAAGGAGUCGAU | 847-865 | 845 |
| 112 | NUCGACUCCUUCUAUGGUN | 531 | NACCAUAGAAGGAGUCGAN | 847-865 | 845 |
| 113 | AUCGACUCCUUCUAUGGUC | 532 | GACCAUAGAAGGAIUCGAU | 847-865 | 845 |
| 114 | NUCGACUCCUUCUAUGGUC | 533 | GACCAUAGAAGGAIUCGAN | 847-865 | 845 |
| 115 | AUCGACUCCUUCUAUGGUN | 534 | NACCAUAGAAGGAIUCGAU | 847-865 | 845 |
| 116 | NUCGACUCCUUCUAUGGUN | 535 | NACCAUAGAAGGAIUCGAN | 847-865 | 845 |
| 117 | CCAGGUAGAUGUUCAUGGA | 536 | UCCAUGAACAUCUACCUGG | 929-947 | 927 |
| 118 | UCAGGUAGAUGUUCAUGGA | 537 | UCCAUGAACAUCUACCUGA | 929-947 | 927 |
| 119 | NCAGGUAGAUGUUCAUGGA | 538 | UCCAUGAACAUCUACCUGN | 929-947 | 927 |
| 120 | UCAGGUAGAUGUUCAUGGN | 539 | NCCAUGAACAUCUACCUGA | 929-947 | 927 |
| 121 | NCAGGUAGAUGUUCAUGGN | 540 | NCCAUGAACAUCUACCUGN | 929-947 | 927 |
| 122 | CCAGGUAGAUGUUCAUGGA | 541 | UCCAUGAACAUCUACCUIG | 929-947 | 927 |
| 123 | UCAGGUAGAUGUUCAUGGA | 542 | UCCAUGAACAUCUACCUIA | 929-947 | 927 |
| 124 | NCAGGUAGAUGUUCAUGGA | 543 | UCCAUGAACAUCUACCUIN | 929-947 | 927 |
| 125 | UCAGGUAGAUGUUCAUGGN | 544 | NCCAUGAACAUCUACCUIA | 929-947 | 927 |
| 126 | NCAGGUAGAUGUUCAUGGN | 545 | NCCAUGAACAUCUACCUIN | 929-947 | 927 |
| 127 | UCUAGCACCAGGUAGAUGU | 546 | ACAUCUACCUGGUGCUAGA | 936-954 | 934 |
| 128 | NCUAGCACCAGGUAGAUGU | 547 | ACAUCUACCUGGUGCUAGN | 936-954 | 934 |
| 129 | UCUAGCACCAGGUAGAUGN | 548 | NCAUCUACCUGGUGCUAGA | 936-954 | 934 |

TABLE 2-continued

CFB RNAi Agent Antisense Strand and Sense Strand Core Stretch Base Sequences
(N = any nucleobase;)

| SEQ ID No. | Antisense Strand Base Sequence (5' → 3') (Shown as an Unmodified Nucleotide Sequence) | SEQ ID No. | Sense Strand Base Sequence (5' → 3') (Shown as an Unmodified Nucleotide Sequence) | Corresponding Positions of Identified Sequence on SEQ ID NO: 1 | Targeted Gene Position |
|---|---|---|---|---|---|
| 130 | NCUAGCACCAGGUAGAUGN | 549 | NCAUCUACCUGGUGCUAGN | 936-954 | 934 |
| 131 | UCUAGCACCAGGUAGAUGU | 550 | ACAUCUACCUGGUICUAGA | 936-954 | 934 |
| 132 | NCUAGCACCAGGUAGAUGU | 551 | ACAUCUACCUGGUICUAGN | 936-954 | 934 |
| 133 | UCUAGCACCAGGUAGAUGN | 552 | NCAUCUACCUGGUICUAGA | 936-954 | 934 |
| 134 | NCUAGCACCAGGUAGAUGN | 553 | NCAUCUACCUGGUICUAGN | 936-954 | 934 |
| 135 | CAUCUAGCACCAGGUAGAU | 554 | AUCUACCUGGUGCUAGAUG | 938-956 | 936 |
| 136 | UAUCUAGCACCAGGUAGAU | 555 | AUCUACCUGGUGCUAGAUG | 938-956 | 936 |
| 137 | NAUCUAGCACCAGGUAGAU | 556 | AUCUACCUGGUGCUAGAUN | 938-956 | 936 |
| 138 | UAUCUAGCACCAGGUAGAN | 557 | NUCUACCUGGUGCUAGAUG | 938-956 | 936 |
| 139 | NAUCUAGCACCAGGUAGAN | 558 | NUCUACCUGGUGCUAGAUN | 938-956 | 936 |
| 140 | CCAUCUAGCACCAGGUAGA | 559 | UCUACCUGGUGCUAGAUGG | 939-957 | 937 |
| 141 | UCAUCUAGCACCAGGUAGA | 560 | UCUACCUGGUGCUAGAUGA | 939-957 | 937 |
| 142 | NCAUCUAGCACCAGGUAGA | 561 | UCUACCUGGUGCUAGAUGN | 939-957 | 937 |
| 143 | UCAUCUAGCACCAGGUAGN | 562 | NCUACCUGGUGCUAGAUGA | 939-957 | 937 |
| 144 | NCAUCUAGCACCAGGUAGN | 563 | NCUACCUGGUGCUAGAUGN | 939-957 | 937 |
| 145 | UCCAUCUAGCACCAGGUAG | 564 | CUACCUGGUGCUAGAUGGA | 940-958 | 938 |
| 146 | NCCAUCUAGCACCAGGUAG | 565 | CUACCUGGUGCUAGAUGGN | 940-958 | 938 |
| 147 | UCCAUCUAGCACCAGGUAN | 566 | NUACCUGGUGCUAGAUGGA | 940-958 | 938 |
| 148 | NCCAUCUAGCACCAGGUAN | 567 | NUACCUGGUGCUAGAUGGN | 940-958 | 938 |
| 149 | UCCAUCUAGCACCAGGUAG | 568 | CUACCUGGUGCUAGAUIGA | 940-958 | 938 |
| 150 | NCCAUCUAGCACCAGGUAG | 569 | CUACCUGGUGCUAGAUIGN | 940-958 | 938 |
| 151 | UCCAUCUAGCACCAGGUAN | 570 | NUACCUGGUGCUAGAUIGA | 940-958 | 938 |
| 152 | NCCAUCUAGCACCAGGUAN | 571 | NUACCUGGUGCUAGAUIGN | 940-958 | 938 |
| 153 | AUCCAUCUAGCACCAGGUA | 572 | UACCUGGUGCUAGAUGGAU | 941-959 | 939 |
| 154 | UUCCAUCUAGCACCAGGUA | 573 | UACCUGGUGCUAGAUGGAA | 941-959 | 939 |
| 155 | NUCCAUCUAGCACCAGGUA | 574 | UACCUGGUGCUAGAUGGAN | 941-959 | 939 |
| 156 | AUCCAUCUAGCACCAGGUN | 575 | NACCUGGUGCUAGAUGGAU | 941-959 | 939 |
| 157 | NUCCAUCUAGCACCAGGUN | 576 | NACCUGGUGCUAGAUGGAN | 941-959 | 939 |
| 158 | AUCCAUCUAGCACCAGGUA | 577 | UACCUGGUGCUAGAUIGAU | 941-959 | 939 |
| 159 | UUCCAUCUAGCACCAGGUA | 578 | UACCUGGUGCUAGAUIGAA | 941-959 | 939 |
| 160 | NUCCAUCUAGCACCAGGUA | 579 | UACCUGGUGCUAGAUIGAN | 941-959 | 939 |
| 161 | AUCCAUCUAGCACCAGGUN | 580 | NACCUGGUGCUAGAUIGAU | 941-959 | 939 |
| 162 | NUCCAUCUAGCACCAGGUN | 581 | NACCUGGUGCUAGAUIGAN | 941-959 | 939 |
| 163 | UGAUCCAUCUAGCACCAGG | 582 | CCUGGUGCUAGAUGGAUCA | 943-961 | 941 |
| 164 | NGAUCCAUCUAGCACCAGG | 583 | CCUGGUGCUAGAUGGAUCN | 943-961 | 941 |
| 165 | UGAUCCAUCUAGCACCAGN | 584 | NCUGGUGCUAGAUGGAUCA | 943-961 | 941 |

TABLE 2-continued

CFB RNAi Agent Antisense Strand and Sense Strand Core Stretch Base Sequences
(N = any nucleobase;)

| SEQ ID No. | Antisense Strand Base Sequence (5' → 3') (Shown as an Unmodified Nucleotide Sequence) | SEQ ID No. | Sense Strand Base Sequence (5' → 3') (Shown as an Unmodified Nucleotide Sequence) | Corresponding Positions of Identified Sequence on SEQ ID NO: 1 | Targeted Gene Position |
|---|---|---|---|---|---|
| 166 | NGAUCCAUCUAGCACCAGN | 585 | NCUGGUGCUAGAUGGAUCN | 943-961 | 941 |
| 167 | UGAUCCAUCUAGCACCAGG | 586 | CCUGGUGCUAGAUGIAUCA | 943-961 | 941 |
| 168 | NGAUCCAUCUAGCACCAGG | 587 | CCUGGUGCUAGAUGIAUCN | 943-961 | 941 |
| 169 | UGAUCCAUCUAGCACCAGN | 588 | NCUGGUGCUAGAUGIAUCA | 943-961 | 941 |
| 170 | NGAUCCAUCUAGCACCAGN | 589 | NCUGGUGCUAGAUGIAUCN | 943-961 | 941 |
| 171 | UGUCUGAUCCAUCUAGCAC | 590 | GUGCUAGAUGGAUCAGACA | 947-965 | 945 |
| 172 | NGUCUGAUCCAUCUAGCAC | 591 | GUGCUAGAUGGAUCAGACN | 947-965 | 945 |
| 173 | UGUCUGAUCCAUCUAGCAN | 592 | NUGCUAGAUGGAUCAGACA | 947-965 | 945 |
| 174 | NGUCUGAUCCAUCUAGCAN | 593 | NUGCUAGAUGGAUCAGACN | 947-965 | 945 |
| 175 | UGUCUGAUCCAUCUAGCAC | 594 | GUGCUAGAUGGAUCAIACA | 947-965 | 945 |
| 176 | NGUCUGAUCCAUCUAGCAC | 595 | GUGCUAGAUGGAUCAIACN | 947-965 | 945 |
| 177 | UGUCUGAUCCAUCUAGCAN | 596 | NUGCUAGAUGGAUCAIACA | 947-965 | 945 |
| 178 | NGUCUGAUCCAUCUAGCAN | 597 | NUGCUAGAUGGAUCAIACN | 947-965 | 945 |
| 179 | AUGCUGUCUGAUCCAUCUA | 598 | UAGAUGGAUCAGACAGCAU | 951-969 | 949 |
| 180 | UUGCUGUCUGAUCCAUCUA | 599 | UAGAUGGAUCAGACAGCAA | 951-969 | 949 |
| 181 | NUGCUGUCUGAUCCAUCUA | 600 | UAGAUGGAUCAGACAGCAN | 951-969 | 949 |
| 182 | AUGCUGUCUGAUCCAUCUN | 601 | NAGAUGGAUCAGACAGCAU | 951-969 | 949 |
| 183 | NUGCUGUCUGAUCCAUCUN | 602 | NAGAUGGAUCAGACAGCAN | 951-969 | 949 |
| 184 | AUGCUGUCUGAUCCAUCUA | 603 | UAGAUGGAUCAGACAGCAU | 951-969 | 949 |
| 185 | UUGCUGUCUGAUCCAUCUA | 604 | UAGAUGGAUCAGACAICAA | 951-969 | 949 |
| 186 | NUGCUGUCUGAUCCAUCUA | 605 | UAGAUGGAUCAGACAICAN | 951-969 | 949 |
| 187 | AUGCUGUCUGAUCCAUCUN | 606 | NAGAUGGAUCAGACAICAU | 951-969 | 949 |
| 188 | NUGCUGUCUGAUCCAUCUN | 607 | NAGAUGGAUCAGACAICAN | 951-969 | 949 |
| 189 | CCCCAAUGCUGUCUGAUCC | 608 | GGAUCAGACAGCAUUGGGG | 956-974 | 954 |
| 190 | UCCCAAUGCUGUCUGAUCC | 609 | GGAUCAGACAGCAUUGGGA | 956-974 | 954 |
| 191 | NCCCAAUGCUGUCUGAUCC | 610 | GGAUCAGACAGCAUUGGGN | 956-974 | 954 |
| 192 | UCCCAAUGCUGUCUGAUCN | 611 | NGAUCAGACAGCAUUGGGA | 956-974 | 954 |
| 193 | NCCCAAUGCUGUCUGAUCN | 612 | NGAUCAGACAGCAUUGGGN | 956-974 | 954 |
| 194 | CCCCAAUGCUGUCUGAUCC | 613 | GGAUCAGACAGCAUUGIGG | 956-974 | 954 |
| 195 | UCCCAAUGCUGUCUGAUCC | 614 | GGAUCAGACAGCAUUGIGA | 956-974 | 954 |
| 196 | NCCCAAUGCUGUCUGAUCC | 615 | GGAUCAGACAGCAUUGIGN | 956-974 | 954 |
| 197 | UCCCAAUGCUGUCUGAUCN | 616 | NGAUCAGACAGCAUUGIGA | 956-974 | 954 |
| 198 | NCCCAAUGCUGUCUGAUCN | 617 | NGAUCAGACAGCAUUGIGN | 956-974 | 954 |
| 199 | UGACUAGACACUUUUUGGC | 618 | GCCAAAAAGUGUCUAGUCA | 992-1010 | 990 |
| 200 | NGACUAGACACUUUUUGGC | 619 | GCCAAAAAGUGUCUAGUCN | 992-1010 | 990 |

TABLE 2-continued

CFB RNAi Agent Antisense Strand and Sense Strand Core Stretch Base Sequences
(N = any nucleobase;)

| SEQ ID No. | Antisense Strand Base Sequence (5' → 3') (Shown as an Unmodified Nucleotide Sequence) | SEQ ID No. | Sense Strand Base Sequence (5' → 3') (Shown as an Unmodified Nucleotide Sequence) | Corresponding Positions of Identified Sequence on SEQ ID NO: 1 | Targeted Gene Position |
|---|---|---|---|---|---|
| 201 | UGACUAGACACUUUUUGGN | 620 | NCCAAAAGUGUCUAGUCA | 992-1010 | 990 |
| 202 | NGACUAGACACUUUUUGGN | 621 | NCCAAAAGUGUCUAGUCN | 992-1010 | 990 |
| 203 | UGACUAGACACUUUUUGGC | 622 | GCCAAAAGUGUCUAIUCA | 992-1010 | 990 |
| 204 | NGACUAGACACUUUUUGGC | 623 | GCCAAAAGUGUCUAIUCN | 992-1010 | 990 |
| 205 | UGACUAGACACUUUUUGGN | 624 | NCCAAAAGUGUCUAIUCA | 992-1010 | 990 |
| 206 | NGACUAGACACUUUUUGGN | 625 | NCCAAAAGUGUCUAIUCN | 992-1010 | 990 |
| 207 | GUUGACUAGACACUUUUUG | 626 | CAAAAGUGUCUAGUCAAC | 994-1012 | 992 |
| 208 | UUUGACUAGACACUUUUUG | 627 | CAAAAGUGUCUAGUCAAA | 994-1012 | 992 |
| 209 | NUUGACUAGACACUUUUUG | 628 | CAAAAGUGUCUAGUCAAN | 994-1012 | 992 |
| 210 | UUUGACUAGACACUUUUUN | 629 | NAAAAGUGUCUAGUCAAA | 994-1012 | 992 |
| 211 | NUUGACUAGACACUUUUUN | 630 | NAAAAGUGUCUAGUCAAN | 994-1012 | 992 |
| 212 | AAGUUGACUAGACACUUUU | 631 | AAAAGUGUCUAGUCAACUU | 996-1014 | 994 |
| 213 | UAGUUGACUAGACACUUUU | 632 | AAAAGUGUCUAGUCAACUA | 996-1014 | 994 |
| 214 | NAGUUGACUAGACACUUUU | 633 | AAAAGUGUCUAGUCAACUN | 996-1014 | 994 |
| 215 | AAGUUGACUAGACACUUUN | 634 | NAAAGUGUCUAGUCAACUU | 996-1014 | 994 |
| 216 | NAGUUGACUAGACACUUUN | 635 | NAAAGUGUCUAGUCAACUN | 996-1014 | 994 |
| 217 | ACCAUAACUUGCCACCUUC | 636 | GAAGGUGGCAAGUUAUGGU | 1021-1039 | 1019 |
| 218 | UCCAUAACUUGCCACCUUC | 637 | GAAGGUGGCAAGUUAUGGA | 1021-1039 | 1019 |
| 219 | NCCAUAACUUGCCACCUUC | 638 | GAAGGUGGCAAGUUAUGGN | 1021-1039 | 1019 |
| 220 | ACCAUAACUUGCCACCUUN | 639 | NAAGGUGGCAAGUUAUGGU | 1021-1039 | 1019 |
| 221 | NCCAUAACUUGCCACCUUN | 640 | NAAGGUGGCAAGUUAUGGN | 1021-1039 | 1019 |
| 222 | CACCAUAACUUGCCACCUU | 641 | AAGGUGGCAAGUUAUGGUG | 1022-1040 | 1020 |
| 223 | UACCAUAACUUGCCACCUU | 642 | AAGGUGGCAAGUUAUGGUA | 1022-1040 | 1020 |
| 224 | NACCAUAACUUGCCACCUU | 643 | AAGGUGGCAAGUUAUGGUN | 1022-1040 | 1020 |
| 225 | UACCAUAACUUGCCACCUN | 644 | NAGGUGGCAAGUUAUGGUA | 1022-1040 | 1020 |
| 226 | NACCAUAACUUGCCACCUN | 645 | NAGGUGGCAAGUUAUGGUN | 1022-1040 | 1020 |
| 227 | CUUGGCUUCACACCAUAAC | 646 | GUUAUGGUGUGAAGCCAAG | 1032-1050 | 1030 |
| 228 | UUUGGCUUCACACCAUAAC | 647 | GUUAUGGUGUGAAGCCAAA | 1032-1050 | 1030 |
| 229 | NUUGGCUUCACACCAUAAC | 648 | GUUAUGGUGUGAAGCCAAN | 1032-1050 | 1030 |
| 230 | UUUGGCUUCACACCAUAAN | 649 | NUUAUGGUGUGAAGCCAAA | 1032-1050 | 1030 |
| 231 | NUUGGCUUCACACCAUAAN | 650 | NUUAUGGUGUGAAGCCAAN | 1032-1050 | 1030 |
| 232 | CUUGGCUUCACACCAUAAC | 651 | GUUAUGGUGUGAAICCAAG | 1032-1050 | 1030 |
| 233 | UUUGGCUUCACACCAUAAC | 652 | GUUAUGGUGUGAAICCAAA | 1032-1050 | 1030 |
| 234 | NUUGGCUUCACACCAUAAC | 653 | GUUAUGGUGUGAAICCAAN | 1032-1050 | 1030 |
| 235 | UUUGGCUUCACACCAUAAN | 654 | NUUAUGGUGUGAAICCAAA | 1032-1050 | 1030 |
| 236 | NUUGGCUUCACACCAUAAN | 655 | NUUAUGGUGUGAAICCAAN | 1032-1050 | 1030 |

TABLE 2-continued

CFB RNAi Agent Antisense Strand and Sense Strand Core Stretch Base Sequences
(N = any nucleobase;)

| SEQ ID No. | Antisense Strand Base Sequence (5' → 3') (Shown as an Unmodified Nucleotide Sequence) | SEQ ID No. | Sense Strand Base Sequence (5' → 3') (Shown as an Unmodified Nucleotide Sequence) | Corresponding Positions of Identified Sequence on SEQ ID NO: 1 | Targeted Gene Position |
|---|---|---|---|---|---|
| 237 | UCAUCAUGCUGUACACUGC | 656 | GCAGUGUACAGCAUGAUGA | 1208-1226 | 1206 |
| 238 | NCAUCAUGCUGUACACUGC | 657 | GCAGUGUACAGCAUGAUGN | 1208-1226 | 1206 |
| 239 | UCAUCAUGCUGUACACUGN | 658 | NCAGUGUACAGCAUGAUGA | 1208-1226 | 1206 |
| 240 | NCAUCAUGCUGUACACUGN | 659 | NCAGUGUACAGCAUGAUGN | 1208-1226 | 1206 |
| 241 | CCAUGUUGUGCAAUCCAUC | 660 | GAUGGAUUGCACAACAUGG | 1292-1310 | 1290 |
| 242 | UCAUGUUGUGCAAUCCAUC | 661 | GAUGGAUUGCACAACAUGA | 1292-1310 | 1290 |
| 243 | NCAUGUUGUGCAAUCCAUC | 662 | GAUGGAUUGCACAACAUGN | 1292-1310 | 1290 |
| 244 | UCAUGUUGUGCAAUCCAUN | 663 | NAUGGAUUGCACAACAUGA | 1292-1310 | 1290 |
| 245 | NCAUGUUGUGCAAUCCAUN | 664 | NAUGGAUUGCACAACAUGN | 1292-1310 | 1290 |
| 246 | UCAAUGACAGUAAUUGGGU | 665 | ACCCAAUUACUGUCAUUGA | 1317-1335 | 1315 |
| 247 | NCAAUGACAGUAAUUGGGU | 666 | ACCCAAUUACUGUCAUUGN | 1317-1335 | 1315 |
| 248 | UCAAUGACAGUAAUUGGGN | 667 | NCCCAAUUACUGUCAUUGA | 1317-1335 | 1315 |
| 249 | NCAAUGACAGUAAUUGGGN | 668 | NCCCAAUUACUGUCAUUGN | 1317-1335 | 1315 |
| 250 | AUCAAUGACAGUAAUUGGG | 669 | CCCAAUUACUGUCAUUGAU | 1316-1334 | 1316 |
| 251 | UUCAAUGACAGUAAUUGGG | 670 | CCCAAUUACUGUCAUUGAA | 1316-1334 | 1316 |
| 252 | NUCAAUGACAGUAAUUGGG | 671 | CCCAAUUACUGUCAUUGAN | 1316-1334 | 1316 |
| 253 | AUCAAUGACAGUAAUUGGN | 672 | NCCAAUUACUGUCAUUGAU | 1316-1334 | 1316 |
| 254 | NUCAAUGACAGUAAUUGGN | 673 | NCCAAUUACUGUCAUUGAN | 1316-1334 | 1316 |
| 255 | UCAUCAAUGACAGUAAUUG | 674 | CAAUUACUGUCAUUGAUGA | 1320-1338 | 1318 |
| 256 | NCAUCAAUGACAGUAAUUG | 675 | CAAUUACUGUCAUUGAUGA | 1320-1338 | 1318 |
| 257 | UCAUCAAUGACAGUAAUUN | 676 | NAAUUACUGUCAUUGAUGA | 1320-1338 | 1318 |
| 258 | NCAUCAAUGACAGUAAUUN | 677 | NAAUUACUGUCAUUGAUGN | 1320-1338 | 1318 |
| 259 | CGGAUCUCAUCAAUGACAG | 678 | CUGUCAUUGAUGAGAUCCG | 1326-1344 | 1324 |
| 260 | UGGAUCUCAUCAAUGACAG | 679 | CUGUCAUUGAUGAGAUCCA | 1326-1344 | 1324 |
| 261 | NGGAUCUCAUCAAUGACAG | 680 | CUGUCAUUGAUGAGAUCCN | 1326-1344 | 1324 |
| 262 | UGGAUCUCAUCAAUGACAN | 681 | NUGUCAUUGAUGAGAUCCA | 1326-1344 | 1324 |
| 263 | NGGAUCUCAUCAAUGACAN | 682 | NUGUCAUUGAUGAGAUCCN | 1326-1344 | 1324 |
| 264 | CGGAUCUCAUCAAUGACAG | 683 | CUGUCAUUGAUGAIAUCCG | 1326-1344 | 1324 |
| 265 | UGGAUCUCAUCAAUGACAG | 684 | CUGUCAUUGAUGAIAUCCA | 1326-1344 | 1324 |
| 266 | NGGAUCUCAUCAAUGACAG | 685 | CUGUCAUUGAUGAIAUCCN | 1326-1344 | 1324 |
| 267 | UGGAUCUCAUCAAUGACAN | 686 | NUGUCAUUGAUGAIAUCCA | 1326-1344 | 1324 |
| 268 | NGGAUCUCAUCAAUGACAN | 687 | NUGUCAUUGAUGAIAUCCN | 1326-1344 | 1324 |
| 269 | UAGACAUCCAGAUAAUCCU | 688 | AGGAUUAUCUGGAUGUCUA | 1386-1404 | 1384 |
| 270 | NAGACAUCCAGAUAAUCCU | 689 | AGGAUUAUCUGGAUGUCUN | 1386-1404 | 1384 |
| 271 | UAGACAUCCAGAUAAUCCN | 690 | NGGAUUAUCUGGAUGUCUA | 1386-1404 | 1384 |

TABLE 2-continued

CFB RNAi Agent Antisense Strand and Sense Strand Core Stretch Base Sequences
(N = any nucleobase;)

| SEQ ID No. | Antisense Strand Base Sequence (5' → 3') (Shown as an Unmodified Nucleotide Sequence) | SEQ ID No. | Sense Strand Base Sequence (5' → 3') (Shown as an Unmodified Nucleotide Sequence) | Corresponding Positions of Identified Sequence on SEQ ID NO: 1 | Targeted Gene Position |
|---|---|---|---|---|---|
| 272 | NAGACAUCCAGAUAAUCCN | 691 | NGGAUUAUCUGGAUGUCUN | 1386-1404 | 1384 |
| 273 | AAACACAUAGACAUCCAGA | 692 | UCUGGAUGUCUAUGUGUUU | 1393-1411 | 1391 |
| 274 | UAACACAUAGACAUCCAGA | 693 | UCUGGAUGUCUAUGUGUUA | 1393-1411 | 1391 |
| 275 | NAACACAUAGACAUCCAGA | 694 | UCUGGAUGUCUAUGUGUUN | 1393-1411 | 1391 |
| 276 | AAACACAUAGACAUCCAGN | 695 | NCUGGAUGUCUAUGUGUUU | 1393-1411 | 1391 |
| 277 | NAACACAUAGACAUCCAGN | 696 | NCUGGAUGUCUAUGUGUUN | 1393-1411 | 1391 |
| 278 | CCAAACACAUAGACAUCCA | 697 | UGGAUGUCUAUGUGUUUGG | 1395-1413 | 1393 |
| 279 | UCAAACACAUAGACAUCCA | 698 | UGGAUGUCUAUGUGUUUGA | 1395-1413 | 1393 |
| 280 | NCAAACACAUAGACAUCCA | 699 | UGGAUGUCUAUGUGUUUGN | 1395-1413 | 1393 |
| 281 | UCAAACACAUAGACAUCCN | 700 | NGGAUGUCUAUGUGUUUGA | 1395-1413 | 1393 |
| 282 | NCAAACACAUAGACAUCCN | 701 | NGGAUGUCUAUGUGUUUGN | 1395-1413 | 1393 |
| 283 | GCAUUGAUGUUCACUUGGU | 702 | ACCAAGUGAACAUCAAUGC | 1431-1449 | 1429 |
| 284 | UCAUUGAUGUUCACUUGGU | 703 | ACCAAGUGAACAUCAAUGA | 1431-1449 | 1429 |
| 285 | NCAUUGAUGUUCACUUGGU | 704 | ACCAAGUGAACAUCAAUGN | 1431-1449 | 1429 |
| 286 | UCAUUGAUGUUCACUUGGN | 705 | NCCAAGUGAACAUCAAUGA | 1431-1449 | 1429 |
| 287 | NCAUUGAUGUUCACUUGGN | 706 | NCCAAGUGAACAUCAAUGN | 1431-1449 | 1429 |
| 288 | AAAGCAUUGAUGUUCACUU | 707 | AAGUGAACAUCAAUGCUUU | 1434-1452 | 1432 |
| 289 | UAAGCAUUGAUGUUCACUU | 708 | AAGUGAACAUCAAUGCUUA | 1434-1452 | 1432 |
| 290 | NAAGCAUUGAUGUUCACUU | 709 | AAGUGAACAUCAAUGCUUN | 1434-1452 | 1432 |
| 291 | AAAGCAUUGAUGUUCACUN | 710 | NAGUGAACAUCAAUGCUUU | 1434-1452 | 1432 |
| 292 | NAAGCAUUGAUGUUCACUN | 711 | NAGUGAACAUCAAUGCUUN | 1434-1452 | 1432 |
| 293 | AGCCAAAGCAUUGAUGUUC | 712 | GAACAUCAAUGCUUUGGCU | 1438-1456 | 1436 |
| 294 | UGCCAAAGCAUUGAUGUUC | 713 | GAACAUCAAUGCUUUGGCA | 1438-1456 | 1436 |
| 295 | NGCCAAAGCAUUGAUGUUC | 714 | GAACAUCAAUGCUUUGGCN | 1438-1456 | 1436 |
| 296 | AGCCAAAGCAUUGAUGUUN | 715 | NAACAUCAAUGCUUUGGCU | 1438-1456 | 1436 |
| 297 | NGCCAAAGCAUUGAUGUUN | 716 | NAACAUCAAUGCUUUGGCN | 1438-1456 | 1436 |
| 298 | AGCCAAAGCAUUGAUGUUC | 717 | GAACAUCAAUGCUUUGICU | 1438-1456 | 1436 |
| 299 | UGCCAAAGCAUUGAUGUUC | 718 | GAACAUCAAUGCUUUGICA | 1438-1456 | 1436 |
| 300 | NGCCAAAGCAUUGAUGUUC | 719 | GAACAUCAAUGCUUUGICN | 1438-1456 | 1436 |
| 301 | AGCCAAAGCAUUGAUGUUN | 720 | NAACAUCAAUGCUUUGICU | 1438-1456 | 1436 |
| 302 | NGCCAAAGCAUUGAUGUUN | 721 | NAACAUCAAUGCUUUGICN | 1438-1456 | 1436 |
| 303 | GAAGCCAAAGCAUUGAUGU | 722 | ACAUCAAUGCUUUGGCUUC | 1440-1458 | 1438 |
| 304 | UAAGCCAAAGCAUUGAUGU | 723 | ACAUCAAUGCUUUGGCUUA | 1440-1458 | 1438 |
| 305 | NAAGCCAAAGCAUUGAUGU | 724 | ACAUCAAUGCUUUGGCUUN | 1440-1458 | 1438 |
| 306 | UAAGCCAAAGCAUUGAUGN | 725 | NCAUCAAUGCUUUGGCUUA | 1440-1458 | 1438 |
| 307 | NAAGCCAAAGCAUUGAUGN | 726 | NCAUCAAUGCUUUGGCUUN | 1440-1458 | 1438 |

TABLE 2-continued

CFB RNAi Agent Antisense Strand and Sense Strand Core Stretch Base Sequences (N = any nucleobase;)

| SEQ ID No. | Antisense Strand Base Sequence (5' → 3') (Shown as an Unmodified Nucleotide Sequence) | SEQ ID No. | Sense Strand Base Sequence (5' → 3') (Shown as an Unmodified Nucleotide Sequence) | Corresponding Positions of Identified Sequence on SEQ ID NO: 1 | Targeted Gene Position |
|---|---|---|---|---|---|
| 308 | GAAGCCAAAGCAUUGAUGU | 727 | ACAUCAAUGCUUUGICUUC | 1440-1458 | 1438 |
| 309 | UAAGCCAAAGCAUUGAUGU | 728 | ACAUCAAUGCUUUGICUUA | 1440-1458 | 1438 |
| 310 | NAAGCCAAAGCAUUGAUGU | 729 | ACAUCAAUGCUUUGICUUN | 1440-1458 | 1438 |
| 311 | UAAGCCAAAGCAUUGAUGN | 730 | NCAUCAAUGCUUUGICUUA | 1440-1458 | 1438 |
| 312 | NAAGCCAAAGCAUUGAUGN | 731 | NCAUCAAUGCUUUGICUUN | 1440-1458 | 1438 |
| 313 | UGUUGCUCAUUGUCUUUCU | 732 | AGAAAGACAAUGAGCAACA | 1461-1479 | 1459 |
| 314 | NGUUGCUCAUUGUCUUUCU | 733 | AGAAAGACAAUGAGCAACN | 1461-1479 | 1459 |
| 315 | UGUUGCUCAUUGUCUUUCN | 734 | NGAAAGACAAUGAGCAACA | 1461-1479 | 1459 |
| 316 | NGUUGCUCAUUGUCUUUCN | 735 | NGAAAGACAAUGAGCAACN | 1461-1479 | 1459 |
| 317 | UGUUGCUCAUUGUCUUUCU | 736 | AGAAAGACAAUGAICAACA | 1461-1479 | 1459 |
| 318 | NGUUGCUCAUUGUCUUUCU | 737 | AGAAAGACAAUGAICAACN | 1461-1479 | 1459 |
| 319 | UGUUGCUCAUUGUCUUUCN | 738 | NGAAAGACAAUGAICAACA | 1461-1479 | 1459 |
| 320 | NGUUGCUCAUUGUCUUUCN | 739 | NGAAAGACAAUGAICAACN | 1461-1479 | 1459 |
| 321 | ACAUGUUGCUCAUUGUCUU | 740 | AAGACAAUGAGCAACAUGU | 1464-1482 | 1462 |
| 322 | UCAUGUUGCUCAUUGUCUU | 741 | AAGACAAUGAGCAACAUGA | 1464-1482 | 1462 |
| 323 | NCAUGUUGCUCAUUGUCUU | 742 | AAGACAAUGAGCAACAUGN | 1464-1482 | 1462 |
| 324 | ACAUGUUGCUCAUUGUCUN | 743 | NAGACAAUGAGCAACAUGU | 1464-1482 | 1462 |
| 325 | NCAUGUUGCUCAUUGUCUN | 744 | NAGACAAUGAGCAACAUGN | 1464-1482 | 1462 |
| 326 | CAUGCCACAGAGACUCAGA | 745 | UCUGAGUCUCUGUGGCAUG | 1549-1567 | 1547 |
| 327 | UAUGCCACAGAGACUCAGA | 746 | UCUGAGUCUCUGUGGCAUA | 1549-1567 | 1547 |
| 328 | NAUGCCACAGAGACUCAGA | 747 | UCUGAGUCUCUGUGGCAUN | 1549-1567 | 1547 |
| 329 | UAUGCCACAGAGACUCAGN | 748 | NCUGAGUCUCUGUGGCAUA | 1549-1567 | 1547 |
| 330 | NAUGCCACAGAGACUCAGN | 749 | NCUGAGUCUCUGUGGCAUN | 1549-1567 | 1547 |
| 331 | CAUGCCACAGAGACUCAGA | 750 | UCUGAGUCUCUGUGICAUG | 1549-1567 | 1547 |
| 332 | UAUGCCACAGAGACUCAGA | 751 | UCUGAGUCUCUGUGICAUA | 1549-1567 | 1547 |
| 333 | NAUGCCACAGAGACUCAGA | 752 | UCUGAGUCUCUGUGICAUN | 1549-1567 | 1547 |
| 334 | UAUGCCACAGAGACUCAGN | 753 | NCUGAGUCUCUGUGICAUA | 1549-1567 | 1547 |
| 335 | NAUGCCACAGAGACUCAGN | 754 | NCUGAGUCUCUGUGICAUN | 1549-1567 | 1547 |
| 336 | UUGCUUGUGGUAAUCGGUA | 755 | UACCGAUUACCACAAGCAA | 1588-1606 | 1586 |
| 337 | NUGCUUGUGGUAAUCGGUA | 756 | UACCGAUUACCACAAGCAN | 1588-1606 | 1586 |
| 338 | UUGCUUGUGGUAAUCGGUN | 757 | NACCGAUUACCACAAGCAA | 1588-1606 | 1586 |
| 339 | NUGCUUGUGGUAAUCGGUN | 758 | NACCGAUUACCACAAGCAN | 1588-1606 | 1586 |
| 340 | UUGCUUGUGGUAAUCGGUA | 759 | UACCGAUUACCACAAICAA | 1588-1606 | 1586 |
| 341 | NUGCUUGUGGUAAUCGGUA | 760 | UACCGAUUACCACAAICAN | 1588-1606 | 1586 |
| 342 | UUGCUUGUGGUAAUCGGUN | 761 | NACCGAUUACCACAAICAA | 1588-1606 | 1586 |

TABLE 2-continued

CFB RNAi Agent Antisense Strand and Sense Strand Core Stretch Base Sequences
(N = any nucleobase;)

| SEQ ID No. | Antisense Strand Base Sequence (5' → 3') (Shown as an Unmodified Nucleotide Sequence) | SEQ ID No. | Sense Strand Base Sequence (5' → 3') (Shown as an Unmodified Nucleotide Sequence) | Corresponding Positions of Identified Sequence on SEQ ID NO: 1 | Targeted Gene Position |
|---|---|---|---|---|---|
| 343 | NUGCUUGUGGUAAUCGGUN | 762 | NACCGAUUACCACAAICAN | 1588-1606 | 1586 |
| 344 | GGUUGCUUGUGGUAAUCGG | 763 | CCGAUUACCACAAGCAACC | 1590-1608 | 1588 |
| 345 | UGUUGCUUGUGGUAAUCGG | 764 | CCGAUUACCACAAGCAACA | 1590-1608 | 1588 |
| 346 | NGUUGCUUGUGGUAAUCGG | 765 | CCGAUUACCACAAGCAACN | 1590-1608 | 1588 |
| 347 | UGUUGCUUGUGGUAAUCGN | 766 | NCGAUUACCACAAGCAACA | 1590-1608 | 1588 |
| 348 | NGUUGCUUGUGGUAAUCGN | 767 | NCGAUUACCACAAGCAACN | 1590-1608 | 1588 |
| 349 | GGUUGCUUGUGGUAAUCGG | 768 | CCGAUUACCACAAICAACC | 1590-1608 | 1588 |
| 350 | UGUUGCUUGUGGUAAUCGG | 769 | CCGAUUACCACAAICAACA | 1590-1608 | 1588 |
| 351 | NGUUGCUUGUGGUAAUCGG | 770 | CCGAUUACCACAAICAACN | 1590-1608 | 1588 |
| 352 | UGUUGCUUGUGGUAAUCGN | 771 | NCGAUUACCACAAICAACA | 1590-1608 | 1588 |
| 353 | NGUUGCUUGUGGUAAUCGN | 772 | NCGAUUACCACAAICAACN | 1590-1608 | 1588 |
| 354 | CUGAGAUCUUGGCCUGCCA | 773 | UGGCAGGCCAAGAUCUCAG | 1610-1628 | 1608 |
| 355 | UUGAGAUCUUGGCCUGCCA | 774 | UGGCAGGCCAAGAUCUCAA | 1610-1628 | 1608 |
| 356 | NUGAGAUCUUGGCCUGCCA | 775 | UGGCAGGCCAAGAUCUCAN | 1610-1628 | 1608 |
| 357 | UUGAGAUCUUGGCCUGCCN | 776 | NGGCAGGCCAAGAUCUCAA | 1610-1628 | 1608 |
| 358 | NUGAGAUCUUGGCCUGCCN | 777 | NGGCAGGCCAAGAUCUCAN | 1610-1628 | 1608 |
| 359 | AAAGUACUCAGACACCACA | 778 | UGUGGUGUCUGAGUACUUU | 1669-1687 | 1667 |
| 360 | UAAGUACUCAGACACCACA | 779 | UGUGGUGUCUGAGUACUUA | 1669-1687 | 1667 |
| 361 | UAAGUACUCAGACACCAUA | 780 | UGUGGUGUCUGAGUACUUA | 1669-1687 | 1667 |
| 362 | NAAGUACUCAGACACCACA | 781 | UGUGGUGUCUGAGUACUUN | 1669-1687 | 1667 |
| 363 | AAAGUACUCAGACACCACN | 782 | NGUGGUGUCUGAGUACUUU | 1669-1687 | 1667 |
| 364 | UAAGUACUCAGACACCACN | 783 | NGUGGUGUCUGAGUACUUA | 1669-1687 | 1667 |
| 365 | NAAGUACUCAGACACCACN | 784 | NGUGGUGUCUGAGUACUUN | 1669-1687 | 1667 |
| 366 | AAAGUACUCAGACACCACA | 785 | UGUGGUGUCUGAGUACUUU | 1669-1687 | 1667 |
| 367 | UAAGUACUCAGACACUACA | 786 | UGUGGUGUCUGAGUACUUA | 1669-1687 | 1667 |
| 368 | NAAGUACUCAGACACUACA | 787 | UGUGGUGUCUGAGUACUUN | 1669-1687 | 1667 |
| 369 | AAAGUACUCAGACACUACN | 788 | NGUGGUGUCUGAGUACUUU | 1669-1687 | 1667 |
| 370 | UAAGUACUCAGACACUACN | 789 | NGUGGUGUCUGAGUACUUA | 1669-1687 | 1667 |
| 371 | NAAGUACUCAGACACUACN | 790 | NGUGGUGUCUGAGUACUUN | 1669-1687 | 1667 |
| 372 | NAAGUACUCAGACACCAUA | 791 | UGUGGUGUCUGAGUACUUN | 1669-1687 | 1667 |
| 373 | UAAGUACUCAGACACCAUN | 792 | NGUGGUGUCUGAGUACUUA | 1669-1687 | 1667 |
| 374 | NAAGUACUCAGACACCAUN | 793 | NGUGGUGUCUGAGUACUUN | 1669-1687 | 1667 |
| 375 | AGCACAAAGUACUCAGACA | 794 | UGUCUGAGUACUUUGUGCU | 1674-1692 | 1672 |
| 376 | UGCACAAAGUACUCAGACA | 795 | UGUCUGAGUACUUUGUGCA | 1674-1692 | 1672 |
| 377 | NGCACAAAGUACUCAGACA | 796 | UGUCUGAGUACUUUGUGCN | 1674-1692 | 1672 |
| 378 | AGCACAAAGUACUCAGACN | 797 | NGUCUGAGUACUUUGUGCU | 1674-1692 | 1672 |

TABLE 2-continued

CFB RNAi Agent Antisense Strand and Sense Strand Core Stretch Base Sequences
(N = any nucleobase;)

| SEQ ID No. | Antisense Strand Base Sequence (5' → 3') (Shown as an Unmodified Nucleotide Sequence) | SEQ ID No. | Sense Strand Base Sequence (5' → 3') (Shown as an Unmodified Nucleotide Sequence) | Corresponding Positions of Identified Sequence on SEQ ID NO: 1 | Targeted Gene Position |
|---|---|---|---|---|---|
| 379 | NGCACAAAGUACUCAGACN | 798 | NGUCUGAGUACUUUGUGCN | 1674-1692 | 1672 |
| 380 | AGCACAAAGUACUCAGACA | 799 | UGUCUGAGUACUUUGUICU | 1674-1692 | 1672 |
| 381 | UGCACAAAGUACUCAGACA | 800 | UGUCUGAGUACUUUGUICA | 1674-1692 | 1672 |
| 382 | NGCACAAAGUACUCAGACA | 801 | UGUCUGAGUACUUUGUICN | 1674-1692 | 1672 |
| 383 | AGCACAAAGUACUCAGACN | 802 | NGUCUGAGUACUUUGUICU | 1674-1692 | 1672 |
| 384 | NGCACAAAGUACUCAGACN | 803 | NGUCUGAGUACUUUGUICN | 1674-1692 | 1672 |
| 385 | CAGCACAAAGUACUCAGAC | 804 | GUCUGAGUACUUUGUGCUG | 1675-1693 | 1673 |
| 386 | UAGCACAAAGUACUCAGAC | 805 | GUCUGAGUACUUUGUGCUA | 1675-1693 | 1673 |
| 387 | NAGCACAAAGUACUCAGAC | 806 | GUCUGAGUACUUUGUGCUN | 1675-1693 | 1673 |
| 388 | UAGCACAAAGUACUCAGAN | 807 | NUCUGAGUACUUUGUGCUA | 1675-1693 | 1673 |
| 389 | NAGCACAAAGUACUCAGAN | 808 | NUCUGAGUACUUUGUGCUN | 1675-1693 | 1673 |
| 390 | CAGCACAAAGUACUCAGAC | 809 | GUCUGAGUACUUUGUICUG | 1675-1693 | 1673 |
| 391 | UAGCACAAAGUACUCAGAC | 810 | GUCUGAGUACUUUGUICUA | 1675-1693 | 1673 |
| 392 | NAGCACAAAGUACUCAGAC | 811 | GUCUGAGUACUUUGUICUN | 1675-1693 | 1673 |
| 393 | UAGCACAAAGUACUCAGAN | 812 | NUCUGAGUACUUUGUICUA | 1675-1693 | 1673 |
| 394 | NAGCACAAAGUACUCAGAN | 813 | NUCUGAGUACUUUGUICUN | 1675-1693 | 1673 |
| 395 | AAACAAUGUGCUGCUGUCA | 814 | UGACAGCAGCACAUUGUUU | 1692-1710 | 1690 |
| 396 | UAACAAUGUGCUGCUGUCA | 815 | UGACAGCAGCACAUUGUUA | 1692-1710 | 1690 |
| 397 | NAACAAUGUGCUGCUGUCA | 816 | UGACAGCAGCACAUUGUUN | 1692-1710 | 1690 |
| 398 | AAACAAUGUGCUGCUGUCN | 817 | NGACAGCAGCACAUUGUUU | 1692-1710 | 1690 |
| 399 | NAACAAUGUGCUGCUGUCN | 818 | NGACAGCAGCACAUUGUUN | 1692-1710 | 1690 |
| 400 | GCUUGAUCAGGGCAACGUC | 819 | GACGUUGCCCUGAUCAAGC | 1853-1871 | 1851 |
| 401 | UCUUGAUCAGGGCAACGUC | 820 | GACGUUGCCCUGAUCAAGA | 1853-1871 | 1851 |
| 402 | NCUUGAUCAGGGCAACGUC | 821 | GACGUUGCCCUGAUCAAGN | 1853-1871 | 1851 |
| 403 | UCUUGAUCAGGGCAACGUN | 822 | NACGUUGCCCUGAUCAAGA | 1853-1871 | 1851 |
| 404 | NCUUGAUCAGGGCAACGUN | 823 | NACGUUGCCCUGAUCAAGN | 1853-1871 | 1851 |
| 405 | AGCUUGAUCAGGGCAACGU | 824 | ACGUUGCCCUGAUCAAGCU | 1854-1872 | 1852 |
| 406 | UGCUUGAUCAGGGCAACGU | 825 | ACGUUGCCCUGAUCAAGCA | 1854-1872 | 1852 |
| 407 | NGCUUGAUCAGGGCAACGU | 826 | ACGUUGCCCUGAUCAAGCN | 1854-1872 | 1852 |
| 408 | AGCUUGAUCAGGGCAACGN | 827 | NCGUUGCCCUGAUCAAGCU | 1854-1872 | 1852 |
| 409 | NGCUUGAUCAGGGCAACGN | 828 | NCGUUGCCCUGAUCAAGCN | 1854-1872 | 1852 |
| 410 | AGCUUGAUCAGGGCAACGU | 829 | ACGUUGCCCUGAUCAAICU | 1854-1872 | 1852 |
| 411 | UGCUUGAUCAGGGCAACGU | 830 | ACGUUGCCCUGAUCAAICA | 1854-1872 | 1852 |
| 412 | NGCUUGAUCAGGGCAACGU | 831 | ACGUUGCCCUGAUCAAICN | 1854-1872 | 1852 |
| 413 | AGCUUGAUCAGGGCAACGN | 832 | NCGUUGCCCUGAUCAAICU | 1854-1872 | 1852 |

TABLE 2-continued

CFB RNAi Agent Antisense Strand and Sense Strand Core Stretch Base Sequences
(N = any nucleobase;)

| SEQ ID No. | Antisense Strand Base Sequence (5' → 3') (Shown as an Unmodified Nucleotide Sequence) | SEQ ID No. | Sense Strand Base Sequence (5' → 3') (Shown as an Unmodified Nucleotide Sequence) | Corresponding Positions of Identified Sequence on SEQ ID NO: 1 | Targeted Gene Position |
|---|---|---|---|---|---|
| 414 | NGCUUGAUCAGGGCAACGN | 833 | NCGUUGCCCUGAUCAAICN | 1854-1872 | 1852 |
| 415 | UACACCAACUUGAAUGAAA | 834 | UUUCAUUCAAGUUGGUGUA | 2257-2275 | 2255 |
| 416 | NACACCAACUUGAAUGAAA | 835 | UUUCAUUCAAGUUGGUGUN | 2257-2275 | 2255 |
| 417 | UACACCAACUUGAAUGAAN | 836 | NUUCAUUCAAGUUGGUGUA | 2257-2275 | 2255 |
| 418 | NACACCAACUUGAAUGAAN | 837 | NUUCAUUCAAGUUGGUGUN | 2257-2275 | 2255 |
| 419 | UACACCAACUUGAAUGAAA | 838 | UUUCAUUCAAGUUGIUGUA | 2257-2275 | 2255 |
| 420 | NACACCAACUUGAAUGAAA | 839 | UUUCAUUCAAGUUGIUGUN | 2257-2275 | 2255 |
| 421 | UACACCAACUUGAAUGAAN | 840 | NUUCAUUCAAGUUGIUGUA | 2257-2275 | 2255 |
| 422 | NACACCAACUUGAAUGAAN | 841 | NUUCAUUCAAGUUGIUGUN | 2257-2275 | 2255 |
| 423 | CACUACUCCCCAGCUGAUU | 842 | AAUCAGCUGGGGAGUAGUG | 2275-2293 | 2273 |
| 424 | UACUACUCCCCAGCUGAUU | 843 | AAUCAGCUGGGGAGUAGUA | 2275-2293 | 2273 |
| 425 | NACUACUCCCCAGCUGAUU | 844 | AAUCAGCUGGGGAGUAGUN | 2275-2293 | 2273 |
| 426 | UACUACUCCCCAGCUGAUN | 845 | NAUCAGCUGGGGAGUAGUA | 2275-2293 | 2273 |
| 427 | NACUACUCCCCAGCUGAUN | 846 | NAUCAGCUGGGGAGUAGUN | 2275-2293 | 2273 |
| 428 | CACUACUCCCCAGCUGAUU | 847 | (A2N)AUCAGCUGGGGAGUAGUG | 2275-2293 | 2273 |
| 429 | UACUACUCCCCAGCUGAUU | 848 | (A2N)AUCAGCUGGGGAGUAGUA | 2275-2293 | 2273 |
| 430 | NACUACUCCCCAGCUGAUU | 849 | (A2N)AUCAGCUGGGGAGUAGUN | 2275-2293 | 2273 |
| 431 | UCCACUACUCCCCAGCUGA | 850 | UCAGCUGGGGAGUAGUGGA | 2277-2295 | 2275 |
| 432 | NCCACUACUCCCCAGCUGA | 851 | UCAGCUGGGGAGUAGUGGN | 2277-2295 | 2275 |
| 433 | UCCACUACUCCCCAGCUGN | 852 | NCAGCUGGGGAGUAGUGGA | 2277-2295 | 2275 |
| 434 | NCCACUACUCCCCAGCUGN | 853 | NCAGCUGGGGAGUAGUGGN | 2277-2295 | 2275 |
| 435 | UCCACUACUCCCCAGCUGA | 854 | UCAGCUGGGGAGUAGUIGA | 2277-2295 | 2275 |
| 436 | NCCACUACUCCCCAGCUGA | 855 | UCAGCUGGGGAGUAGUIGN | 2277-2295 | 2275 |
| 437 | UCCACUACUCCCCAGCUGN | 856 | NCAGCUGGGGAGUAGUIGA | 2277-2295 | 2275 |
| 438 | NCCACUACUCCCCAGCUGN | 857 | NCAGCUGGGGAGUAGUIGN | 2277-2295 | 2275 |
| 439 | GACAUCCACUACUCCCCAG | 858 | CUGGGGAGUAGUGGAUGUC | 2281-2299 | 2279 |
| 440 | UACAUCCACUACUCCCCAG | 859 | CUGGGGAGUAGUGGAUGUA | 2281-2299 | 2279 |
| 441 | NACAUCCACUACUCCCCAG | 860 | CUGGGGAGUAGUGGAUGUN | 2281-2299 | 2279 |
| 442 | UACAUCCACUACUCCCCAN | 861 | NUGGGGAGUAGUGGAUGUA | 2281-2299 | 2279 |
| 443 | NACAUCCACUACUCCCCAN | 862 | NUGGGGAGUAGUGGAUGUN | 2281-2299 | 2279 |
| 444 | GACAUCCACUACUCCCCAG | 863 | CUGGGGAGUAGUGIAUGUC | 2281-2299 | 2279 |
| 445 | UACAUCCACUACUCCCCAG | 864 | CUGGGGAGUAGUGIAUGUA | 2281-2299 | 2279 |
| 446 | NACAUCCACUACUCCCCAG | 865 | CUGGGGAGUAGUGIAUGUN | 2281-2299 | 2279 |
| 447 | UACAUCCACUACUCCCCAN | 866 | NUGGGGAGUAGUGIAUGUA | 2281-2299 | 2279 |
| 448 | NACAUCCACUACUCCCCAN | 867 | NUGGGGAGUAGUGIAUGUN | 2281-2299 | 2279 |
| 449 | CAGACAUCCACUACUCCCC | 868 | GGGGAGUAGUGGAUGUCUG | 2283-2301 | 2281 |

TABLE 2-continued

CFB RNAi Agent Antisense Strand and Sense Strand Core Stretch Base Sequences
(N = any nucleobase;)

| SEQ ID No. | Antisense Strand Base Sequence (5' → 3') (Shown as an Unmodified Nucleotide Sequence) | SEQ ID No. | Sense Strand Base Sequence (5' → 3') (Shown as an Unmodified Nucleotide Sequence) | Corresponding Positions of Identified Sequence on SEQ ID NO: 1 | Targeted Gene Position |
|---|---|---|---|---|---|
| 450 | UAGACAUCCACUACUCCCC | 869 | GGGGAGUAGUGGAUGUCUA | 2283-2301 | 2281 |
| 451 | NAGACAUCCACUACUCCCC | 870 | GGGGAGUAGUGGAUGUCUN | 2283-2301 | 2281 |
| 452 | UAGACAUCCACUACUCCCN | 871 | NGGGAGUAGUGGAUGUCUA | 2283-2301 | 2281 |
| 453 | NAGACAUCCACUACUCCCN | 872 | NGGGAGUAGUGGAUGUCUN | 2283-2301 | 2281 |
| 454 | AACCCAAAUCCUCAUCUUG | 873 | CAAGAUGAGGAUUUGGGUU | 2396-2414 | 2394 |
| 455 | UACCCAAAUCCUCAUCUUG | 874 | CAAGAUGAGGAUUUGGGUA | 2396-2414 | 2394 |
| 456 | NACCCAAAUCCUCAUCUUG | 875 | CAAGAUGAGGAUUUGGGUN | 2396-2414 | 2394 |
| 457 | AACCCAAAUCCUCAUCUUN | 876 | NAAGAUGAGGAUUUGGGUU | 2396-2414 | 2394 |
| 458 | NACCCAAAUCCUCAUCUUN | 877 | NAAGAUGAGGAUUUGGGUN | 2396-2414 | 2394 |
| 459 | AACCCAAAUCCUCAUCUUG | 878 | CAAGAUGAGGAUUUGIGUU | 2396-2414 | 2394 |
| 460 | UACCCAAAUCCUCAUCUUG | 879 | CAAGAUGAGGAUUUGIGUA | 2396-2414 | 2394 |
| 461 | NACCCAAAUCCUCAUCUUG | 880 | CAAGAUGAGGAUUUGIGUN | 2396-2414 | 2394 |
| 462 | AACCCAAAUCCUCAUCUUN | 881 | NAAGAUGAGGAUUUGIGUU | 2396-2414 | 2394 |
| 463 | NACCCAAAUCCUCAUCUUN | 882 | NAAGAUGAGGAUUUGIGUN | 2396-2414 | 2394 |
| 464 | AAACCCAAAUCCUCAUCUU | 883 | AAGAUGAGGAUUUGGGUUU | 2397-2415 | 2395 |
| 465 | UAACCCAAAUCCUCAUCUU | 884 | AAGAUGAGGAUUUGGGUUA | 2397-2415 | 2395 |
| 466 | NAACCCAAAUCCUCAUCUU | 885 | AAGAUGAGGAUUUGGGUUN | 2397-2415 | 2395 |
| 467 | AAACCCAAAUCCUCAUCUN | 886 | NAGAUGAGGAUUUGGGUUU | 2397-2415 | 2395 |
| 468 | NAACCCAAAUCCUCAUCUN | 887 | NAGAUGAGGAUUUGGGUUN | 2397-2415 | 2395 |
| 469 | AAACCCAAAUCCUCAUCUU | 888 | AAGAUGAGGAUUUGIGUUU | 2397-2415 | 2395 |
| 470 | UAACCCAAAUCCUCAUCUU | 889 | AAGAUGAGGAUUUGIGUUA | 2397-2415 | 2395 |
| 471 | NAACCCAAAUCCUCAUCUU | 890 | AAGAUGAGGAUUUGIGUUN | 2397-2415 | 2395 |
| 472 | AAACCCAAAUCCUCAUCUN | 891 | NAGAUGAGGAUUUGIGUUU | 2397-2415 | 2395 |
| 473 | NAACCCAAAUCCUCAUCUN | 892 | NAGAUGAGGAUUUGIGUUN | 2397-2415 | 2395 |
| 474 | UAGAAAACCCAAAUCCUCA | 893 | UGAGGAUUUGGGUUUUCUA | 2401-2419 | 2399 |
| 475 | NAGAAAACCCAAAUCCUCA | 894 | UGAGGAUUUGGGUUUUCUN | 2401-2419 | 2399 |
| 476 | UAGAAAACCCAAAUCCUCN | 895 | NGAGGAUUUGGGUUUUCUA | 2401-2419 | 2399 |
| 477 | NAGAAAACCCAAAUCCUCN | 896 | NGAGGAUUUGGGUUUUCUN | 2401-2419 | 2399 |

($A^{2N}$) = 2-aminoadenine-containing nucleotide; I = hypoxanthine (inosine) nucleotide The CFB RNAi agent sense strands and antisense strands that comprise or consist of the sequences in Table 2 can be modified nucleotides or unmodified nucleotides. In some embodiments, the CFB RNAi agents having the sense and antisense strand sequences that comprise or consist of the sequences in Table 2 are all or substantially all modified nucleotides.

In some embodiments, the antisense strand of a CFB RNAi agent disclosed herein differs by 0, 1, 2, or 3 nucleotides from any of the antisense strand sequences in Table 2.

In some embodiments, the sense strand of a CFB RNAi agent disclosed herein differs by 0, 1, 2, or 3 nucleotides from any of the sense strand sequences in Table 2.

As used herein, each N listed in a sequence disclosed in Table 2 may be independently selected from any and all nucleobases (including those found on both modified and unmodified nucleotides). In some embodiments, an N nucleotide listed in a sequence disclosed in Table 2 has a nucleobase that is complementary to the N nucleotide at the corresponding position on the other strand. In some embodiments, an N nucleotide listed in a sequence disclosed in Table 2 has a nucleobase that is not complementary to the N nucleotide at the corresponding position on the other strand. In some embodiments, an N nucleotide listed in a sequence disclosed in Table 2 has a nucleobase that is the same as the N nucleotide at the corresponding position on the other strand. In some embodiments, an N nucleotide listed in a sequence disclosed in Table 2 has a nucleobase that is different from the N nucleotide at the corresponding position on the other strand.

Certain modified CFB RNAi agent antisense strands, as well as their underlying unmodified nucleobase sequences, are provided in Table 3. Certain modified CFB RNAi agent sense strands, as well as their underlying unmodified nucleobase sequences, are provided in Table 4A or Table 4B. In forming CFB RNAi agents, each of the nucleotides in each of the underlying base sequences listed in Tables 3 and 4A and 4B, as well as in Table 2, above, can be a modified nucleotide.

The CFB RNAi agents described herein are formed by annealing an antisense strand with a sense strand. A sense strand containing a sequence listed in Table 2 or Table 4A or Table 4B, can be hybridized to any antisense strand containing a sequence listed in Table 2 or Table 3, provided the two sequences have a region of at least 85% complementarity over a contiguous 15, 16, 17, 18, 19, 20, or 21 nucleotide sequence.

In some embodiments, a CFB RNAi agent antisense strand comprises a nucleotide sequence of any of the sequences in Table 2 or Table 3.

In some embodiments, a CFB RNAi agent comprises or consists of a duplex having the nucleobase sequences of the sense strand and the antisense strand of any of the sequences in Table 2, Table 3 or Table 4A or Table 4B. In some embodiments, a CFB RNAi agent comprises or consists of a duplex sequence prepared or provided as a sodium salt, mixed salt, or a free-acid.

Examples of antisense strands containing modified nucleotides are provided in Table 3 and Table 5C. Examples of sense strands containing modified nucleotides are provided in Table 4A, Table 4B, and Table 5C.

As used in Tables 3, 4A, 4B, and 5C, the following notations are used to indicate modified nucleotides and linking groups:

A=adenosine-3'-phosphate;
C=cytidine-3'-phosphate;
G=guanosine-3'-phosphate;
U=uridine-3'-phosphate
I=inosine-3'-phosphate
a=2'-O-methyladenosine-3'-phosphate
as =2'-O-methyladenosine-3'-phosphorothioate
ass=2'-O-methyladenosine-3'-phosphorodithioate
c=2'-O-methylcytidine-3'-phosphate
cs=2'-O-methylcytidine-3'-phosphorothioate
css=2'-O-methylcytidine-3'-phosphorodithioate
g=2'-O-methylguanosine-3'-phosphate
gs=2'-O-methylguanosine-3'-phosphorothioate
gss=2'-O-methylguanosine-3'-phosphorodithioate
t=2'-O-methyl-5-methyluridine-3'-phosphate
ts=2'-O-methyl-5-methyluridine-3'-phosphorothioate
tss=2'-O-methyl-5-methyluridine-3'-phosphorodithioate
u=2'-O-methyluridine-3'-phosphate
us=2'-O-methyluridine-3'-phosphorothioate
uss=2'-O-methyluridine-3'-phosphorodithioate
i=2'-O-methylinosine-3'-phosphate
is =2'-O-methylinosine-3'-phosphorothioate
iss=2'-O-methylinosine-3'-phosphorodithioate Af=2'-fluoroadenosine-3'-phosphate
Afs=2'-fluoroadenosine-3'-phosporothioate
Cf=2'-fluorocytidine-3'-phosphate
Cfs=2'-fluorocytidine-3'-phosphorothioate
Gf=2'-fluoroguanosine-3'-phosphate
Gfs=2'-fluoroguanosine-3'-phosphorothioate
Tf=2'-fluoro-5'-methyluridine-3'-phosphate
Tfs=2'-fluoro-5'-methyluridine-3'-phosphorothioate
Uf=2'-fluorouridine-3'-phosphate
Ufs=2'-fluorouridine-3'-phosphorothioate
dA=2'-deoxyadenosine-3'-phosphate
dAs=2'-deoxyadenosine-3'-phosphorothioate
dAss=2'-deoxyadenosine-3'-phosphorodithioate
dC=2'-deoxycytidine-3'-phosphate
dCs=2'-deoxycytidine-3'-phosphorothioate
dCss=2'-deoxycytidine-3'-phosphorodithioate
dG=2'-deoxyguanosine-3'-phosphate
dGs=2'-deoxyguanosine-3'-phosphorothioate
dGss=2'-deoxyguanosine-3'-phosphorodithioate
dT=2'-deoxy-5-methyluridine-3'-phosphate (or 2'-O-deoxythymidine-3'-phosphate)
dTs=2'-deoxy-5-methyluridine-3'-phosphorothioate (or 2'-O-deoxythymidine-3'-phosphorothioate)
dTss=2'-deoxy-5-methyluridine-3'-phosphorodithioate (or 2'-O-deoxythymidine-3'-phosphorodithioate)
$A_{UNA}$=2',3'-seco-adenosine-3'-phosphate (see Table 6)
$A_{UNAS}$=2',3'-seco-adenosine-3'-phosphorothioate (see Table 6)
$C_{UNA}$=2',3'-seco-cytidine-3'-phosphate (see Table 6)
$C_{UNAS}$=2',3'-seco-cytidine-3'-phosphorothioate (see Table 6)
$G_{UNA}$=2',3'-seco-guanosine-3'-phosphate (see Table 6)
$G_{UNAS}$=2',3'-seco-guanosine-3'-phosphorothioate (see Table 6)
$U_{UNA}$=2',3'-seco-uridine-3'-phosphate (see Table 6)
$U_{UNAS}$=2',3'-seco-uridine-3'-phosphorothioate (see Table 6)
a_2N=2'-O-methyl-2-aminoadenosine-3'-phosphate (see Table 6)
a_2Ns=2'-O-methyl-2-aminoadenosine-3'-phosphorothioate (see Table 6)
(invdA)=inverted (3'-3' linked) 2'-deoxyadenosine (see Table 6)
(invAb)=inverted abasic deoxyribonucleotide (see Table 6)
(invAb)s=inverted abasic deoxyribonucleotide-5'-phosphorothioate (see Table 6)
cPrpa=5'-cyclopropyl phosphonate-2'-O-methyladenosine-3'-phosphate (see Table 6)
cPrpas=5'-cyclopropyl phosphonate-2'-O-methyladenosine-3'-phosphorothioate (see Table 6)
cPrpu=5'-cyclopropyl phosphonate-2'-O-methyluridine-3'-phosphate (see Table 6)
cPrpus=5'-cyclopropyl phosphonate-2'-O-methyluridine-3'-phosphorothioate (see Table 6)
NAG37=see Table 6
NAG37s=see Table 6

As the person of ordinary skill in the art would readily understand, unless otherwise indicated by the sequence (such as, for example, by a phosphorothioate linkage "s"), when present in an oligonucleotide, the nucleotide monomers are mutually linked by 5'-3'-phosphodiester bonds. As the person of ordinary skill in the art would clearly understand, the inclusion of a phosphorothioate linkage as shown in the modified nucleotide sequences disclosed herein replaces the phosphodiester linkage typically present in oligonucleotides. Further, the person of ordinary skill in the art would readily understand that the terminal nucleotide at the 3' end of a given oligonucleotide sequence would typically have a hydroxyl (—OH) group at the respective 3' position of the given monomer instead of a phosphate moiety ex vivo. Additionally, for the embodiments disclosed herein, when viewing the respective strand 5'→3', the inverted abasic residues are inserted such that the 3' position of the deoxyribose is linked at the 3' end of the preceding monomer on the respective strand (see, e.g., Table 6). Moreover, as the person of ordinary skill would readily understand and appreciate, while the phosphorothioate chemical structures depicted herein typically show the anion on the sulfur atom, the inventions disclosed herein encompass all phosphorothioate tautomers and resonance structures (e.g., where the sulfur atom has a double-bond and the anion is on an oxygen atom). Unless expressly indicated otherwise herein, such understandings of the person of ordinary skill in the art are used when describing the CFB RNAi agents and compositions of CFB RNAi agents disclosed herein.

Certain examples of targeting ligands, targeting groups, and linking groups used with the CFB RNAi agents disclosed herein are provided below in Table 6. More specifically, targeting groups and linking groups (which together can form a targeting ligand) include (NAG37) and (NAG37)s, for which their chemical structures are provided below in Table 6. Each sense strand and/or antisense strand can have any targeting ligands, targeting groups, or linking groups listed herein, as well as other groups, conjugated to the 5' and/or 3' end of the sequence.

TABLE 3

CFB RNAi Agent Antisense Strand Sequences

| Antisense Strand ID: | ModifiedAntisense Strand (5' → 3') | SEQ ID NO. | Underlying Base Sequence (5' → 3') (Shown as an Unmodified Nucleotide Sequence) | SEQ ID NO. |
|---|---|---|---|---|
| AM17115-AS | usAfsusCfuAfgCfaCfcAfgGfuAfgAfuGfsc | 897 | UAUCUAGCACCAGGUAGAUGC | 1267 |
| AM17117-AS | usCfsasUfcUfaGfcAfcCfaGfgUfaGfaUfsg | 898 | UCAUCUAGCACCAGGUAGAUG | 1268 |
| AM17119-AS | usCfscsAfuCfuAfgCfaCfcAfgGfuAfgAfsu | 899 | UCCAUCUAGCACCAGGUAGAU | 1269 |
| AM17121-AS | asUfscsCfaUfcUfaGfcAfcCfaGfgUfaGfsa | 900 | AUCCAUCUAGCACCAGGUAGA | 1270 |
| AM17123-AS | usGfsasUfcCfaUfcUfaGfcAfcCfaGfgUfsa | 901 | UGAUCCAUCUAGCACCAGGUA | 1271 |
| AM17125-AS | usGfsusCfuGfaUfcCfaUfcUfaGfcAfcCfsa | 902 | UGUCUGAUCCAUCUAGCACCA | 1272 |
| AM17127-AS | asUfsgsCfuGfuCfuGfaUfcCfaUfcUfaGfsc | 903 | AUGCUGUCUGAUCCAUCUAGC | 1273 |
| AM17129-AS | usAfsusGfcCfaCfaGfaGfaCfuCfaGfaGfsa | 904 | UAUGCCACAGAGACUCAGAGA | 1274 |
| AM17131-AS | asAfsasGfuAfcUfcAfgAfcAfcCfaCfaGfsc | 905 | AAAGUACUCAGACACCACAGC | 1275 |
| AM17133-AS | usAfscsAfcCfaAfcUfuGfaAfuGfaAfaCfsg | 906 | UACACCAACUUGAAUGAAACG | 1276 |
| AM17135-AS | usAfscsUfaCfuCfcCfcAfgCfuGfaUfuAfsc | 907 | UACUACUCCCCAGCUGAUUAC | 1277 |
| AM17137-AS | usCfscsAfcUfaCfuCfcCfcAfgCfuGfaUfsc | 908 | UCCACUACUCCCCAGCUGAUC | 1278 |
| AM17139-AS | usAfscsAfuCfcAfcUfaCfuCfcCfcAfgCfsu | 909 | UACAUCCACUACUCCCCAGCU | 1279 |
| AM17141-AS | usAfsgsAfcAfuCfcAfcUfaCfuCfcCfcAfsg | 910 | UAGACAUCCACUACUCCCCAG | 1280 |
| AM17143-AS | asAfscsCfcAfaAfuCfcUfcAfuCfuUfgGfsa | 911 | AACCCAAAUCCUCAUCUUGGA | 1281 |
| AM17145-AS | asAfsasCfcCfaAfaUfcCfuCfaUfcUfuGfsg | 912 | AAACCCAAAUCCUCAUCUUGG | 1282 |
| AM17147-AS | usAfsgsAfaAfaCfcCfaAfaUfcCfuCfaUfsc | 913 | UAGAAACCCAAAUCCUCAUC | 1283 |
| AM17667-AS | usAfsgsAfaaacccaAfaUfcCfucausc | 914 | UAGAAACCCAAAUCCUCAUC | 1283 |
| AM17668-AS | usAfsgsaAfaacccaAfaUfcCfucausc | 915 | UAGAAACCCAAAUCCUCAUC | 1283 |
| AM17669-AS | usAfsgsaaaAfcccaAfaUfcCfucausc | 916 | UAGAAACCCAAAUCCUCAUC | 1283 |
| AM17670-AS | usAfsgsaaaacCfcaAfaUfcCfucausc | 917 | UAGAAACCCAAAUCCUCAUC | 1283 |
| AM17671-AS | usAfsgsAfaAfacccaaaUfcCfucausc | 918 | UAGAAACCCAAAUCCUCAUC | 1283 |
| AM17672-AS | usAfsgsaaAfacccaaaUfcCfucausc | 919 | UAGAAACCCAAAUCCUCAUC | 1283 |
| AM17673-AS | usAfsgsaaaacccaaaUfcCfucausc | 920 | UAGAAACCCAAAUCCUCAUC | 1283 |
| AM17674-AS | usAfsgsaaaacccaAfaUfccucausc | 921 | UAGAAACCCAAAUCCUCAUC | 1283 |
| AM17675-AS | usAfsgsaAfaacccaaaUfccucausc | 922 | UAGAAACCCAAAUCCUCAUC | 1283 |
| AM17676-AS | usAfsgAfaaacccaAfaUfcCfucausc | 923 | UAGAAACCCAAAUCCUCAUC | 1283 |

TABLE 3-continued

CFB RNAi Agent Antisense Strand Sequences

| Antisense Strand ID: | ModifiedAntisense Strand (5' → 3') | SEQ ID NO. | Underlying Base Sequence (5' → 3') (Shown as an Unmodified Nucleotide Sequence) | SEQ ID NO. |
|---|---|---|---|---|
| AM17677-AS | usAfgAfaaacccaAfaUfcCfucaussc | 1429 | UAGAAAACCCAAAUCCUCAUC | 1283 |
| AM17681-AS | cPrpusAfsgsAfaaacccaAfaUfcCfucausc | 924 | UAGAAAACCCAAAUCCUCAUC | 1283 |
| AM17683-AS | asGfsusGfuAfaCfcCfuCfaUfaGfcAfgUfsg | 925 | AGUGUAACCGUCAUAGCAGUG | 1284 |
| AM17685-AS | usUfsusGfaCfuAfgAfcAfcUfuUfuUfgGfsc | 926 | UUUGACUAGACACUUUUUGGC | 1285 |
| AM17687-AS | asAfsgsUfuGfaCfuAfgAfcAfcUfuUfuUfsg | 927 | AAGUUGACUAGACACUUUUUG | 1286 |
| AM17689-AS | usAfscsCfaUfaAfcUfuGfcCfaCfcUfuCfsu | 928 | UACCAUAACUUGCCACCUUCU | 1287 |
| AM17691-AS | usCfsasUfgUfuGfuGfcAfaUfcCfaUfcAfsg | 929 | UCAUGUUGUGCAAUCCAUCAG | 1288 |
| AM17693-AS | usCfsasUfcAfaUfgAfcAfgUfaAfuUfgGfsg | 930 | UCAUCAAUGACAGUAAUUGGG | 1289 |
| AM17695-AS | usCfsasUfuGfaUfgUfuCfaCfuUfgGfuUfsc | 931 | UCAUUGAUGUUCACUUGGUUC | 1290 |
| AM17697-AS | usUfsgsCfuUfgUfgGfuAfaUfcGfgUfaCfsc | 932 | UUGCUUGUGGUAAUCGGUACC | 1291 |
| AM17699-AS | usGfsusUfgCfuUfgUfgGfuAfaUfcGfgUfsg | 933 | UGUUGCUUGUGGUAAUCGGUG | 1292 |
| AM17701-AS | usUfsgsAfgAfuCfuUfgGfcCfuGfcCfaUfsg | 934 | UUGAGAUCUUGGCCUGCCAUG | 1293 |
| AM17703-AS | usCfsusUfgAfuCfaGfgGfcAfaCfgUfcAfsc | 935 | UCUUGAUCAGGGCAACGUCAC | 1294 |
| AM17705-AS | asGfscsUfuGfaUfcAfgGfgCfaAfcGfuCfsa | 936 | AGCUUGAUCAGGGCAACGUCA | 1295 |
| AM17707-AS | usAfsasGfcCfaGfaAfgGfaCfaCfaCfgUfsa | 937 | UAAGCCAGAAGGACACACGUA | 1296 |
| AM17709-AS | asAfsasGfaGfaUfcUfcAfuCfaCfuCfaCfsa | 938 | AAAGAGAUCUCAUCACUCACA | 1297 |
| AM17711-AS | usGfsasAfaGfaGfaUfcUfcAfuCfaCfuCfsa | 939 | UGAAAGAGAUCUCAUCACUCA | 1298 |
| AM17713-AS | usAfscsAfuGfaAfgGfaGfuCfuUfgGfcAfsg | 940 | UACAUGAAGGAGUCUUGGCAG | 1299 |
| AM17715-AS | usCfsgsUfaCfaUfgAfaGfgAfgUfcUfuGfsg | 941 | UCGUACAUGAAGGAGUCUUGG | 1300 |
| AM17717-AS | usUfsgsUfcGfuAfcAfuGfaAfgGfaGfuCfsu | 942 | UUGUCGUACAUGAAGGAGUCU | 1301 |
| AM17719-AS | asUfscsGfaCfuCfcUfuCfuAfuGfgUfcUfsc | 943 | AUCGACUCCUUCUAUGGUCUC | 1302 |
| AM17721-AS | usCfsasGfgUfaGfaUfgUfuCfaUfgGfaGfsc | 944 | UCAGGUAGAUGUUCAUGGAGC | 1303 |
| AM17723-AS | usCfsusAfgCfaCfcAfgGfuAfgAfuGfuUfsc | 945 | UCUAGCACCAGGUAGAUGUUC | 1304 |
| AM17725-AS | usCfscsCfaAfuGfcUfgUfcUfgAfuCfcAfsc | 946 | UCCCAAUGCUGUCUGAUCCAC | 1305 |
| AM17727-AS | usGfsasCfuAfgAfcAfcUfuUfuUfgGfcUfsc | 947 | UGACUAGACACUUUUUGGCUC | 1306 |
| AM17729-AS | asCfscsAfuAfaCfuUfgCfcAfcCfuUfcUfsc | 948 | ACCAUAACUUGCCACCUUCUC | 1307 |
| AM17731-AS | usUfsusGfgCfuUfcAfcAfcCfaUfaAfcUfsc | 949 | UUUGGCUUCACACCAUAACUC | 1308 |
| AM17733-AS | usCfsasUfcAfuGfcUfgUfaCfaCfuGfcCfsu | 950 | UCAUCAUGCUGUACACUGCCU | 1309 |
| AM17735-AS | usCfsasAfuGfaCfaGfuAfaUfuGfgGfuCfsc | 951 | UCAAUGACAGUAAUUGGGUCC | 1310 |
| AM17737-AS | asUfscsAfaUfgAfcAfgUfaAfuUfgGfgUfsc | 952 | AUCAAUGACAGUAAUUGGGUC | 1311 |
| AM17739-AS | usGfsgsAfuCfuCfaUfcAfaUfgAfcAfgUfsg | 953 | UGGAUCUCAUCAAUGACAGUG | 1312 |
| AM17741-AS | usAfsgsAfcAfuCfcAfgAfuAfaUfcCfuCfsc | 954 | UAGACAUCCAGAUAAUCCUCC | 1313 |
| AM17743-AS | asAfsasCfaCfaUfaGfaCfaUfcCfaGfaUfsg | 955 | AAACACAUAGACAUCCAGAUG | 1314 |
| AM17745-AS | usCfsasAfaCfaCfaUfaGfaCfaUfcCfaGfsa | 956 | UCAAACACAUAGACAUCCAGA | 1315 |
| AM17747-AS | asAfsasGfcAfuUfgAfuGfuUfcAfcUfuGfsg | 957 | AAAGCAUUGAUGUUCACUUGG | 1316 |
| AM17749-AS | asGfscsCfaAfaGfcAfuUfgAfuGfuUfcAfsc | 958 | AGCCAAAGCAUUGAUGUUCAC | 1317 |

TABLE 3-continued

CFB RNAi Agent Antisense Strand Sequences

| Antisense Strand ID: | ModifiedAntisense Strand (5' → 3') | SEQ ID NO. | Underlying Base Sequence (5' → 3') (Shown as an Unmodified Nucleotide Sequence) | SEQ ID NO. |
| --- | --- | --- | --- | --- |
| AM17751-AS | usAfsasGfcCfaAfaGfcAfuUfgAfuGfuUfsc | 959 | UAAGCCAAAGCAUUGAUGUUC | 1318 |
| AM17753-AS | usGfsusUfgCfuCfaUfuGfuCfuUfuCfuUfsg | 960 | UGUUGCUCAUUGUCUUUCUUG | 1319 |
| AM17755-AS | asCfsasUfgUfuGfcUfcAfuUfgUfcUfuUfsc | 961 | ACAUGUUGCUCAUUGUCUUUC | 1320 |
| AM17757-AS | asGfscsAfcAfaAfgUfaCfuCfaGfaCfaCfsc | 962 | AGCACAAAGUACUCAGACACC | 1321 |
| AM17759-AS | usAfsgsCfaCfaAfaGfuAfcUfcAfgAfcAfsc | 963 | UAGCACAAAGUACUCAGACAC | 1322 |
| AM17761-AS | asAfsasCfaAfuGfuGfcUfgCfuGfuCfaGfsc | 964 | AAACAAUGUGCUGCUGUCAGC | 1323 |
| AM17762-AS | asAfsasGfuacucagAfcAfcCfacagsc | 965 | AAAGUACUCAGACACCACAGC | 1275 |
| AM17763-AS | asAfsasgUfacucagAfcAfcCfacagsc | 966 | AAAGUACUCAGACACCACAGC | 1275 |
| AM17764-AS | asAfsasguaCfucagAfcAfcCfacagsc | 967 | AAAGUACUCAGACACCACAGC | 1275 |
| AM17765-AS | asAfsasguacuCfagAfcAfcCfacagsc | 968 | AAAGUACUCAGACACCACAGC | 1275 |
| AM17766-AS | asAfsasGfuAfcucagacAfcCfacagsc | 969 | AAAGUACUCAGACACCACAGC | 1275 |
| AM17767-AS | asAfsasguAfcucagacAfcCfacagsc | 970 | AAAGUACUCAGACACCACAGC | 1275 |
| AM17768-AS | asAfsasguacucagAfcAfccacagsc | 971 | AAAGUACUCAGACACCACAGC | 1275 |
| AM17769-AS | asAfsasguacucagacAfcCfacagsc | 972 | AAAGUACUCAGACACCACAGC | 1275 |
| AM17770-AS | asAfsasgUfacucagacAfccacagsc | 973 | AAAGUACUCAGACACCACAGC | 1275 |
| AM17771-AS | asAfsaGfuacucagAfcAfcCfacagsc | 974 | AAAGUACUCAGACACCACAGC | 1275 |
| AM17772-AS | asAfaGfuacucagAfcAfcCfacagssc | 975 | AAAGUACUCAGACACCACAGC | 1275 |
| AM17776-AS | cPrpasAfsasGfuacucagAfcAfcCfacagsc | 976 | AAAGUACUCAGACACCACAGC | 1275 |
| AM18396-AS | usAfgaAfaacccaAfaUfcCfucaussc | 977 | UAGAAAACCCAAAUCCUCAUC | 1283 |
| AM18397-AS | usAfgaaaacccaAfaUfccucaussc | 978 | UAGAAAACCCAAAUCCUCAUC | 1283 |
| AM18482-AS | asAfsaguacuCfagAfcAfcCfacagsc | 979 | AAAGUACUCAGACACCACAGC | 1275 |
| AM18483-AS | asAfsagUfacucagacAfccacagsc | 980 | AAAGUACUCAGACACCACAGC | 1275 |
| AM18484-AS | dAssAfsaguacuCfagAfcAfcCfacagsc | 981 | AAAGUACUCAGACACCACAGC | 1275 |
| AM18485-AS | dAssAfsagUfacucagacAfccacagsc | 982 | AAAGUACUCAGACACCACAGC | 1275 |
| AM18618-AS | asAfsaguaCfucagAfcAfcCfacagsc | 983 | AAAGUACUCAGACACCACAGC | 1275 |
| AM18619-AS | dAssAfaguaCfucagAfcAfcCfacagsc | 984 | AAAGUACUCAGACACCACAGC | 1275 |
| AM19035-AS | dTssAfgaAfaacccaAfaUfcCfucausc | 985 | TAGAAAACCCAAAUCCUCAUC | 1420 |
| AM19036-AS | usAfsgsadAaacccaAfaUfcCfucausc | 986 | UAGAAAACCCAAAUCCUCAUC | 1283 |
| AM19037-AS | usAfsgsadAaacccadAaUfcCfucausc | 987 | UAGAAAACCCAAAUCCUCAUC | 1283 |
| AM19038-AS | usAfsgsaAaacccadAaUfcdCucausc | 988 | UAGAAAACCCAAAUCCUCAUC | 1283 |
| AM19039-AS | usdAsgsadAaacccadAaUfcdCucausc | 989 | UAGAAAACCCAAAUCCUCAUC | 1283 |
| AM19040-AS | usdAsgsadAaacccadAadTcdCucausc | 990 | UAGAAAACCCAAATCCUCAUC | 1421 |
| AM19041-AS | dTssdAgadAaacccadAaUfcdCucausc | 991 | TAGAAAACCCAAAUCCUCAUC | 1420 |
| AM19045-AS | usAfsgsaAfaacccaAfaUfcCfucacsc | 992 | UAGAAAACCCAAAUCCUCACC | 1324 |
| AM19047-AS | usAfsgsaAfaacccaAfaUfcCfucagsc | 993 | UAGAAAACCCAAAUCCUCAGC | 1325 |
| AM19111-AS | usAfsaguaCfucagAfcAfcCfacagsc | 994 | UAAGUACUCAGACACCACAGC | 1326 |
| AM19112-AS | asAfsaguadCucagAfcAfcCfacagsc | 995 | AAAGUACUCAGACACCACAGC | 1275 |

TABLE 3-continued

CFB RNAi Agent Antisense Strand Sequences

| Antisense Strand ID: | ModifiedAntisense Strand (5' → 3') | SEQ ID NO. | Underlying Base Sequence (5' → 3') (Shown as an Unmodified Nucleotide Sequence) | SEQ ID NO. |
| --- | --- | --- | --- | --- |
| AM19113-AS | asAfsaguadCucagdAcAfcdCacagsc | 996 | AAAGUACUCAGACACCACAGC | 1275 |
| AM19114-AS | asdAsaguadCucagdAcAfcdCacagsc | 997 | AAAGUACUCAGACACCACAGC | 1275 |
| AM19115-AS | asdAsaguadCucagdAcdAcdCacagsc | 998 | AAAGUACUCAGACACCACAGC | 1275 |
| AM19116-AS | asdAsaguaCfucagAfcdAcCfacagsc | 999 | AAAGUACUCAGACACCACAGC | 1275 |
| AM19118-AS | asAfsaguaC$_{UNA}$ucagAfcAfcCfacagsc | 1000 | AAAGUACUCAGACACCACAGC | 1275 |
| AM19217-AS | asGfsasAfaAfcCfcAfaAfuCfcUfcAfuCfsu | 1001 | AGAAAACCCAAAUCCUCAUCU | 1327 |
| AM19273-AS | cPrpusAfsgsaAfaacccaAfaUfcCfucausc | 1002 | UAGAAAACCCAAAUCCUCAUC | 1283 |
| AM19274-AS | cPrpasAfsaguaCfucagAfcAfcCfacagsc | 1003 | AAAGUACUCAGACACCACAGC | 1275 |
| AM19316-AS | dTssAfsgsaAfaacccaAfaUfcCfucausc | 1004 | TAGAAAACCCAAAUCCUCAUC | 1420 |
| AM19348-AS | usdAsgsadAadAcccadAaUfccucausc | 1005 | UAGAAAACCCAAAUCCUCAUC | 1283 |
| AM19349-AS | usdAsgsadAaacdCcadAaUfccucausc | 1006 | UAGAAAACCCAAAUCCUCAUC | 1283 |
| AM19350-AS | usdAsgsaaadAcdCcadAaUfccucausc | 1007 | UAGAAAACCCAAAUCCUCAUC | 1283 |
| AM19040-AS | usdAsgsadAaacccadAadTcdCucausc | 1008 | UAGAAAACCCAAATCCUCAUC | 1421 |
| AM19543-AS | usAfsgsaAfaacccaAfaUfcCfucsa | 1009 | UAGAAAACCCAAAUCCUCA | 474 |
| AM19667-AS | usAfsaguaCfuuagAfcAfcCfacagsc | 1010 | UAAGUACUUAGACACCACAGC | 1329 |
| AM19668-AS | usAfsaguaCfucagAfuAfcCfacagsc | 1011 | UAAGUACUCAGAUACCACAGC | 1330 |
| AM19669-AS | usAfsaguaCfucagAfcAfuCfacagsc | 1012 | UAAGUACUCAGACAUCACAGC | 1331 |
| AM19670-AS | usAfsaguaCfucagAfcAfcUfacagsc | 1013 | UAAGUACUCAGACACUACAGC | 1332 |
| AM19671-AS | usAfsaguaCfucagAfcAfcCfauagsc | 1014 | UAAGUACUCAGACACCAUAGC | 1333 |
| AM19688-AS | usCfsasaUfgacaguAfaUfuGfggucsc | 1015 | UCAAUGACAGUAAUUGGGUCC | 1310 |
| AM19689-AS | usCfsasaugAfcaguAfaUfuGfggucsc | 1016 | UCAAUGACAGUAAUUGGGUCC | 1310 |
| AM19690-AS | usCfsasaugacAfguAfaUfuGfggucsc | 1017 | UCAAUGACAGUAAUUGGGUCC | 1310 |
| AM19691-AS | usCfsasaugaCfaguaaUfugggCfsc | 1018 | UCAAUGACAGUAAUUGGGUCC | 1310 |
| AM19692-AS | usCfsasaugAfcaguaaUfugggucsc | 1019 | UCAAUGACAGUAAUUGGGUCC | 1310 |
| AM19693-AS | usCfsasaugacAfguaaUfugggucsc | 1020 | UCAAUGACAGUAAUUGGGUCC | 1310 |
| AM19694-AS | usCfsasaUfgA$_{UNA}$caguAfaUfuGfggucsc | 1021 | UCAAUGACAGUAAUUGGGUCC | 1310 |
| AM19695-AS | usCfsaaugAfcaguAfaUfuGfggucsc | 1022 | UCAAUGACAGUAAUUGGGUCC | 1310 |
| AM19696-AS | usCfsaaugAfcaguAfaUfuGfggucssc | 1023 | UCAAUGACAGUAAUUGGGUCC | 1310 |
| AM19700-AS | dTssCfsasaugAfcaguAfaUfuGfggucsc | 1024 | TCAAUGACAGUAAUUGGGUCC | 1422 |
| AM19894-AS | dTssAfsgaAfaacccaAfaUfcCfucausc | 1025 | TAGAAAACCCAAAUCCUCAUC | 1420 |
| AM19895-AS | dTssAfsgaAfaacccaAfaUfcCfucaussc | 1026 | TAGAAAACCCAAAUCCUCAUC | 1420 |
| AM19896-AS | UfssAfsgaAfaacccaAfaUfcCfucausc | 1027 | UAGAAAACCCAAAUCCUCAUC | 1283 |
| AM19897-AS | UfssAfsgaAfaacccaAfaUfcCfucaussc | 1028 | UAGAAAACCCAAAUCCUCAUC | 1283 |
| AM19898-AS | UfssAfgaAfaacccaAfaUfcCfucaussc | 1029 | UAGAAAACCCAAAUCCUCAUC | 1283 |
| AM19928-AS | isAfsgsaAfaacccaAfaUfcCfucausc | 1030 | IAGAAAACCCAAAUCCUCAUC | 1334 |
| AM20011-AS | asAfsaguaCfucagAfcAfcCfacsa | 1031 | AAAGUACUCAGACACCACA | 359 |

TABLE 3-continued

CFB RNAi Agent Antisense Strand Sequences

| Antisense Strand ID: | ModifiedAntisense Strand (5' → 3') | SEQ ID NO. | Underlying Base Sequence (5' → 3') (Shown as an Unmodified Nucleotide Sequence) | SEQ ID NO. |
|---|---|---|---|---|
| AM20012-AS | asAfsaguaCfucagAfcAfcCfacasgsc | 1032 | AAAGUACUCAGACACCACAGC | 1275 |
| AM20014-AS | asAfsaguaCfucagAfcAfcCfacgsgsc | 1033 | AAAGUACUCAGACACCACGGC | 1336 |
| AM20016-AS | asAfsaguaCfucagAfcAfcCfaccsgsc | 1034 | AAAGUACUCAGACACCACCGC | 1337 |
| AM20021-AS | usAfsaguaCfucagAfcAfcCfauagssc | 1035 | UAAGUACUCAGACACCAUAGC | 1333 |
| AM20022-AS | ussAfsaguaCfucagAfcAfcCfauagsc | 1036 | UAAGUACUCAGACACCAUAGC | 1333 |
| AM20023-AS | ussAfsaguaCfucagAfcAfcCfauagssc | 1037 | UAAGUACUCAGACACCAUAGC | 1333 |
| AM20024-AS | dTssAfsaguaCfucagAfcAfcCfauagssc | 1038 | TAAGUACUCAGACACCAUAGC | 1423 |
| AM20025-AS | cPrpusAfsaguaCfucagAfcAfcCfauagsc | 1039 | UAAGUACUCAGACACCAUAGC | 1333 |
| AM20062-AS | usAfsgaAfaacccaAfaUfcCfucausc | 1040 | UAGAAAACCCAAAUCCUCAUC | 1283 |
| AM20063-AS | usAfsgaAfaacccaAfaUfcCfucacsc | 1041 | UAGAAAACCCAAAUCCUCACC | 1324 |
| AM20064-AS | usAfsgadAaacccaAfaUfcCfucausc | 1042 | UAGAAAACCCAAAUCCUCAUC | 1283 |
| AM20065-AS | usAfsgaaaAfcccaAfaUfcCfucausc | 1043 | UAGAAAACCCAAAUCCUCAUC | 1283 |
| AM20066-AS | usAfsgaaaAfcccaAfaUfcCfucacsc | 1044 | UAGAAAACCCAAAUCCUCACC | 1324 |
| AM20067-AS | usAfsgaaadAcccaAfaUfcCfucausc | 1045 | UAGAAAACCCAAAUCCUCAUC | 1283 |
| AM20069-AS | ussAfsgaAfaacccaAfaUfcCfucausc | 1046 | UAGAAAACCCAAAUCCUCAUC | 1283 |
| AM20070-AS | ussAfsgaAfaacccaAfaUfcCfucacsc | 1047 | UAGAAAACCCAAAUCCUCACC | 1324 |
| AM20071-AS | ussAfsgadAaacccaAfaUfcCfucausc | 1048 | UAGAAAACCCAAAUCCUCAUC | 1283 |
| AM20072-AS | ussAfsgaAfaacccaAfaUfcCfucaussc | 1049 | UAGAAAACCCAAAUCCUCAUC | 1283 |
| AM20073-AS | ussAfsgaAfaacccaAfaUfcCfucacssc | 1050 | UAGAAAACCCAAAUCCUCACC | 1324 |
| AM20074-AS | ussAfsgadAaacccaAfaUfcCfucaussc | 1051 | UAGAAAACCCAAAUCCUCAUC | 1283 |
| AM20192-AS | asAfsaguaCfucagAfcAfcCfacsc | 1052 | AAAGUACUCAGACACCACC | 1338 |
| AM20194-AS | asAfsaguaCfucagAfcAfcCfacsg | 1053 | AAAGUACUCAGACACCACG | 1339 |
| AM20196-AS | asAfsaguaCfucagAfcAfcCfacsa_2N | 1054 | AAAGUACUCAGACACCAC(A$^{2N}$) | 1340 |
| AM20197-AS | cPrpasAfsaguaCfucagAfcAfcCfacsc | 1055 | AAAGUACUCAGACACCACC | 1338 |
| AM20199-AS | usAfsaguaCfucagAfcAfcCfacsc | 1056 | UAAGUACUCAGACACCACC | 1341 |
| AM20200-AS | asAfsaguaCfucagAfcAfcCfascsc | 1057 | AAAGUACUCAGACACCACC | 1338 |
| AM20201-AS | asAfsaguaCfucagAfcAfcCfaccsgssc | 1058 | AAAGUACUCAGACACCACCGC | 1337 |
| AM20202-AS | asAfsaguaCfucagAfcAfcCfaccgssc | 1059 | AAAGUACUCAGACACCACCGC | 1337 |
| AM20203-AS | usAfsgaAfaacccaAfaUfcCfuscsa | 1060 | UAGAAAACCCAAAUCCUCA | 474 |
| AM20204-AS | usAfsgaAfaacccaAfaUfcCfucasusc | 1061 | UAGAAAACCCAAAUCCUCAUC | 1283 |
| AM20206-AS | usAfsgaAfaacccaAfaUfcCfuccsusc | 1062 | UAGAAAACCCAAAUCCUCCUC | 1342 |
| AM20208-AS | usAfsgaAfaacccaAfaUfcCfucgsusc | 1063 | UAGAAAACCCAAAUCCUCGUC | 1343 |
| AM20332-AS | usAfsaguaCfucagAfcAfcdTacagsc | 1064 | UAAGUACUCAGACACTACAGC | 1424 |
| AM20333-AS | usAfsaguaCfucagAfcAfcCfadTagsc | 1065 | UAAGUACUCAGACACCATAGC | 1425 |
| AM20425-AS | isAfsaguaCfucagAfcAfcCfacagsc | 1066 | IAAGUACUCAGACACCACAGC | 1344 |
| AM20494-AS | usAfsaguaCfucacAfcAfcUfacagsc | 1067 | UAAGUACUCACACACUACAGC | 1345 |
| AM20496-AS | usAfsagucCfucacAfcAfcAfacagsc | 1068 | UAAGUCCUCACACACAACAGC | 1346 |

TABLE 3-continued

CFB RNAi Agent Antisense Strand Sequences

| Antisense Strand ID: | Modified Antisense Strand (5' → 3') | SEQ ID NO. | Underlying Base Sequence (5' → 3') (Shown as an Unmodified Nucleotide Sequence) | SEQ ID NO. |
|---|---|---|---|---|
| CA004415 | asAfsaguaCfucagAfcAfcCfacagsu | 1430 | AAAGUACUCAGACACCACAGU | 1437 |
| CA915944 | usAfsaguaCfucagAfcAfcCfacsc | 1431 | UAAGUACUCAGACACCACC | 1341 |

($A^{2N}$) = 2-aminoadenine-containing nucleotide; I = hypoxanthine (inosine) nucleotide

TABLE 4A

CFB RNAi Agent Sense Strand Sequences

| Sense Strand ID: | Modified Sense Strand (5' → 3') | SEQ ID NO. | Underlying Base Sequence (5' → 3') (Shown as an Unmodified Nucleotide Sequence) | SEQ ID NO. |
|---|---|---|---|---|
| AM17114-SS | (NAG37)s(invAb)sgcaucuacCfUfGfgugcuagauas(invAb) | 1069 | GCAUCUACCUGGUGCUAGAUA | 1347 |
| AM17116-SS | (NAG37)s(invAb)scaucuaccUfGfGfugcuagaugas(invAb) | 1070 | CAUCUACCUGGUGCUAGAUGA | 1348 |
| AM17118-SS | (NAG37)s(invAb)saucuaccuGfGfUfgcuagauigas(invAb) | 1071 | AUCUACCUGGUGCUAGAUIGA | 1349 |
| AM17120-SS | (NAG37)s(invAb)sucuaccugGfUfGfcuagauigaus(invAb) | 1072 | UCUACCUGGUGCUAGAUIGAU | 1350 |
| AM17122-SS | (NAG37)s(invAb)suaccugguGfCfUfagaugiaucas(invAb) | 1073 | UACCUGGUGCUAGAUGIAUCA | 1351 |
| AM17124-SS | (NAG37)s(invAb)suggugcuaGfAfUfggaucaiacas(invAb) | 1074 | UGGUGCUAGAUGGAUCAIACA | 1352 |
| AM17126-SS | (NAG37)s(invAb)sgcuagaugGfAfUfcagacaicaus(invAb) | 1075 | GCUAGAUGGAUCAGACAICAU | 1353 |
| AM17128-SS | (NAG37)s(invAb)sucucgagUfCfUfcugugicauas(invAb) | 1076 | UCUCUGAGUCUCUGUGICAUA | 1354 |
| AM17130-SS | (NAG37)s(invAb)sgcuguggUfUfCfugaguacuuus(invAb) | 1077 | GCUGUGGUGUCUGAGUACUUU | 1355 |
| AM17132-SS | (NAG37)s(invAb)scguuucauUfCfAfaguugiuguas(invAb) | 1078 | CGUUUCAUUCAAGUUGIUGUA | 1356 |
| AM17134-SS | (NAG37)s(invAb)sgua_2NaucagCfUfGfgggaguaguas(invAb) | 1079 | GUA($A^{2N}$)UCAGCUGGGGAGUAGUA | 1357 |
| AM17136-SS | (NAG37)s(invAb)sgaucagcuGfGfGfgaguaguigas(invAb) | 1080 | GAUCAGCUGGGGAGUAGUIGA | 1358 |
| AM17138-SS | (NAG37)s(invAb)sagcuggggAfGfUfaguiauguas(invAb) | 1081 | AGCUGGGGAGUAGUIAUGUA | 1359 |
| AM17140-SS | (NAG37)s(invAb)scuggggagUfAfGfuggaugucuas(invAb) | 1082 | CUGGGGAGUAGUGGAUGUCUA | 1360 |
| AM17142-SS | (NAG37)s(invAb)succaagauAfGfGfgauuugiguus(invAb) | 1083 | UCCAAGAUGAGGAUUUGIGUU | 1361 |
| AM17144-SS | (NAG37)s(invAb)sccaagaugAfGfGfauuugiguuus(invAb) | 1084 | CCAAGAUGAGGAUUUGIGUUU | 1362 |
| AM17146-SS | (NAG37)s(invAb)sgaugaggaUfUfUfggguuuucuas(invAb) | 1085 | GAUGAGGAUUUGGGUUUUCUA | 1363 |
| AM17678-SS | (NAG37)s(invAb)sgaugaggaUfuUfgFgguuuucuas(invAb) | 1086 | GAUGAGGAUUUGGGUUUUCUA | 1363 |
| AM17679-SS | (NAG37)s(invAb)sgaugaggaUfuUfgGfguuuucuas(invAb) | 1087 | GAUGAGGAUUUGGGUUUUCUA | 1363 |
| AM17680-SS | (NAG37)s(invAb)sgaugagGfaUfUfUfggguuuucuas(invAb) | 1088 | GAUGAGGAUUUGGGUUUUCUA | 1363 |
| AM17682-SS | (NAG37)s(invAb)scacugcuaUfGfAfcgguuacacus(invAb) | 1089 | CACUGCUAUGACGGUUACACU | 1364 |
| AM17684-SS | (NAG37)s(invAb)sgccaaaaaGfUfGfucuagucaaas(invAb) | 1090 | GCCAAAAAGUGUCUAGUCAAA | 1365 |
| AM17686-SS | (NAG37)s(invAb)sca_2NaaaaguGfUfCfuagucaacuus(invAb) | 1091 | C($A^{2N}$)AAAAGUGUCUAGUCAACUU | 1366 |
| AM17688-SS | (NAG37)s(invAb)sagaaggugGfCfAfaguuaugguas(invAb) | 1092 | AGAAGGUGGCAAGUUAUGGUA | 1367 |
| AM17690-SS | (NAG37)s(invAb)scugauggaUfUfGfcacaacaugas(invAb) | 1093 | CUGAUGGAUUGCACAACAUGA | 1368 |
| AM17692-SS | (NAG37)s(invAb)scccaauuaCfUfGfucauugaugas(invAb) | 1094 | CCCAAUUACUGUCAUUGAUGA | 1369 |
| AM17694-SS | (NAG37)s(invAb)sgaaccaagUfGfAfacaucaaugas(invAb) | 1095 | GAACCAAGUGAACAUCAAUGA | 1370 |

TABLE 4A-continued

CFB RNAi Agent Sense Strand Sequences

| Sense Strand ID: | Modified Sense Strand (5' → 3') | SEQ ID NO. | Underlying Base Sequence (5' → 3') (Shown as an Unmodified Nucleotide Sequence) | SEQ ID NO. |
|---|---|---|---|---|
| AM17696-SS | (NAG37)s(invAb)sgguaccgaUfUfAfccacaaicaas(invAb) | 1096 | GGUACCGAUUACCACAAICAA | 1371 |
| AM17698-SS | (NAG37)s(invAb)scaccgauuAfCfCfacaaicaacas(invAb) | 1097 | CACCGAUUACCACAAICAACA | 1372 |
| AM17700-SS | (NAG37)s(invAb)scauggcagGfCfCfaagaucucaas(invAb) | 1098 | CAUGGCAGGCCAAGAUCUCAA | 1373 |
| AM17702-SS | (NAG37)s(invAb)sgugacguuGfCfCfcugaucaagas(invAb) | 1099 | GUGACGUUGCCCUGAUCAAGA | 1374 |
| AM17704-SS | (NAG37)s(invAb)sugacguugCfCfCfugaucaaicus(invAb) | 1100 | UGACGUUGCCCUGAUCAAICU | 1375 |
| AM17706-SS | (NAG37)s(invAb)suacgugugUfCfCfuucugicuuas(invAb) | 1101 | UACGUGUGUCCUUCUGICUUA | 1376 |
| AM17708-SS | (NAG37)s(invAb)sugugagugAfUfGfagaucucuuus(invAb) | 1102 | UGUGAGUGAUGAGAUCUCUUU | 1377 |
| AM17710-SS | (NAG37)s(invAb)sugagugauGfAfGfaucucuuucas(invAb) | 1103 | UGAGUGAUGAGAUCUCUUUCA | 1378 |
| AM17712-SS | (NAG37)s(invAb)scugccaagAfCfUfccuucauguas(invAb) | 1104 | CUGCCAAGACUCCUUCAUGUA | 1379 |
| AM17714-SS | (NAG37)s(invAb)sccaagacuCfCfUfucauguacias(invAb) | 1105 | CCAAGACUCCUUCAUGUACIA | 1380 |
| AM17716-SS | (NAG37)s(invAb)sagacuccuUfCfAfuguaciacaas(invAb) | 1106 | AGACUCCUUCAUGUACIACAA | 1381 |
| AM17718-SS | (NAG37)s(invAb)sgagaccauAfGfAfaggaiucgaus(invAb) | 1107 | GAGACCAUAGAAGGAIUCGAU | 1382 |
| AM17720-SS | (NAG37)s(invAb)sgcuccaugAfAfCfaucuaccuias(invAb) | 1108 | GCUCCAUGAACAUCUACCUIA | 1383 |
| AM17722-SS | (NAG37)s(invAb)sgaacaucuAfCfCfugguicuagas(invAb) | 1109 | GAACAUCUACCUGGUICUAGA | 1384 |
| AM17724-SS | (NAG37)s(invAb)sguggaucaGfAfCfagcauugigas(invAb) | 1110 | GUGGAUCAGACAGCAUUGIGA | 1385 |
| AM17726-SS | (NAG37)s(invAb)sgagccaaaAfAfGfugucuaiucas(invAb) | 1111 | GAGCCAAAAAGUGUCUAIUCA | 1386 |
| AM17728-SS | (NAG37)s(invAb)sgagaagguGfGfCfaaguuauggus(invAb) | 1112 | GAGAAGGUGGCAAGUUAUGGU | 1387 |
| AM17730-SS | (NAG37)s(invAb)sgaguuaugGfUfGfugaaiccaaas(invAb) | 1113 | GAGUUAUGGUGUGAAICCAAA | 1388 |
| AM17732-SS | (NAG37)s(invAb)saggcagugUfAfCfagcaugaugas(invAb) | 1114 | AGGCAGUGUACAGCAUGAUGA | 1389 |
| AM17734-SS | (NAG37)s(invAb)sggacccaaUfUfAfcugucauugas(invAb) | 1115 | GGACCCAAUUACUGUCAUUGA | 1390 |
| AM17736-SS | (NAG37)s(invAb)sgacccaauUfAfCfugucauugaus(invAb) | 1116 | GACCCAAUUACUGUCAUUGAU | 1391 |
| AM17738-SS | (NAG37)s(invAb)scacugucaUfUfGfaugaiauccas(invAb) | 1117 | CACUGUCAUUGAUGAIAUCCA | 1392 |
| AM17740-SS | (NAG37)s(invAb)sggaggauuAfUfCfuggaugucuas(invAb) | 1118 | GGAGGAUUAUCUGGAUGUCUA | 1393 |
| AM17742-SS | (NAG37)s(invAb)scaucuggaUfGfUfcuauguguuus(invAb) | 1119 | CAUCUGGAUGUCUAUGUGUUU | 1394 |
| AM17744-SS | (NAG37)s(invAb)sucuggaugUfCfUfauguguuugas(invAb) | 1120 | UCUGGAUGUCUAUGUGUUUGA | 1395 |
| AM17746-SS | (NAG37)s(invAb)sccaagugaAfCfAfucaaugcuuus(invAb) | 1121 | CCAAGUGAACAUCAAUGCUUU | 1396 |
| AM17748-SS | (NAG37)s(invAb)sgugaacauCfAfAfugcuuugicus(invAb) | 1122 | GUGAACAUCAAUGCUUUGICU | 1397 |
| AM17750-SS | (NAG37)s(invAb)sgaacaucaAfUfGfcuuugicuuas(invAb) | 1123 | GAACAUCAAUGCUUUGICUUA | 1398 |
| AM17752-SS | (NAG37)s(invAb)scaagaaagAfCfAfaugaicaacas(invAb) | 1124 | CAAGAAAGACAAUGAICAACA | 1399 |
| AM17754-SS | (NAG37)s(invAb)sga_2NaagacaAfUfGfagcaacaugus(invAb) | 1125 | G($A^{2N}$)AAGACAAUGAGCAACAUGU | 1400 |
| AM17756-SS | (NAG37)s(invAb)sggugucugAfGfUfacuuuguicus(invAb) | 1126 | GGUGUCUGAGUACUUUGUICU | 1401 |
| AM17758-SS | (NAG37)s(invAb)sgugucugaGfUfAfcuuuguicuas(invAb) | 1127 | GUGUCUGAGUACUUUGUICUA | 1402 |
| AM17760-SS | (NAG37)s(invAb)sgcugacagCfAfGfcacauuguuus(invAb) | 1128 | GCUGACAGCAGCACAUUGUUU | 1403 |
| AM17773-SS | (NAG37)s(invAb)sgcugugguGfuCfUfgaguacuuus(invAb) | 1129 | GCUGUGGUGUCUGAGUACUUU | 1355 |
| AM17774-SS | (NAG37)s(invAb)sgcugugguGfuCfuGfaguacuuus(invAb) | 1130 | GCUGUGGUGUCUGAGUACUUU | 1355 |
| AM17775-SS | (NAG37)s(invAb)sgcugugGfuGfuCfugaguacuuus(invAb) | 1131 | GCUGUGGUGUCUGAGUACUUU | 1355 |

TABLE 4A-continued

CFB RNAi Agent Sense Strand Sequences

| Sense Strand ID: | Modified Sense Strand (5' → 3') | SEQ ID NO. | Underlying Base Sequence (5' → 3') (Shown as an Unmodified Nucleotide Sequence) | SEQ ID NO. |
|---|---|---|---|---|
| AM19042-SS | (NAG37)s(invAb)sgaugaggaUfuuGfgguuuucuas(invAb) | 1132 | GAUGAGGAUUUGGGUUUUCUA | 1363 |
| AM19043-SS | (NAG37)s(invAb)sgaugaggadTuudGgguuuucuas(invAb) | 1133 | GAUGAGGATUUGGGUUUUCUA | 1426 |
| AM19044-SS | (NAG37)s(invAb)sggugaggaUfuUfGfgguuuucuas(invAb) | 1134 | GGUGAGGAUUUGGGUUUUCUA | 1404 |
| AM19046-SS | (NAG37)s(invAb)sgcugaggaUfuUfGfgguuuucuas(invAb) | 1135 | GCUGAGGAUUUGGGUUUUCUA | 1405 |
| AM19110-SS | (NAG37)s(invAb)sgcugugguGfUfCfugaguacuuas(invAb) | 1136 | GCUGUGGUGUCUGAGUACUUA | 1406 |
| AM19117-SS | (NAG37)s(invAb)sgcugugguduGudCugaguacuuus(invAb) | 1137 | GCUGUGGUGUCUGAGUACUUU | 1355 |
| AM19216-SS | (NAG37)s(invAb)sagaugaggAfUfUfugggguuuucus(invAb) | 1138 | AGAUGAGGAUUUGGGUUUUCU | 1407 |
| AM19351-SS | (NAG37)s(invAb)sgaugaggaUfuUfgggguuuucuas(invAb) | 1139 | GAUGAGGAUUUGGGUUUUCUA | 1363 |
| AM19352-SS | (NAG37)s(invAb)sgaugaggaUuUfgggguuuucuas(invAb) | 1140 | GAUGAGGAUUUGGGUUUUCUA | 1363 |
| AM19353-SS | (NAG37)s(invAb)sgaugaggaUfuUggguuuucuas(invAb) | 1141 | GAUGAGGAUUUGGGUUUUCUA | 1363 |
| AM19354-SS | (NAG37)s(invAb)sgaugaggadTuUfggguuuucuas(invAb) | 1142 | GAUGAGGATUUGGGUUUUCUA | 1426 |
| AM19355-SS | (NAG37)s(invAb)sgaugaggaUfudTggguuuucuas(invAb) | 1143 | GAUGAGGAUUTGGGUUUUCUA | 1427 |
| AM19356-SS | (NAG37)s(invAb)sgaugaggadTudTggguuuucuas(invAb) | 1144 | GAUGAGGATUTGGGUUUUCUA | 1428 |
| AM19357-SS | (NAG37)s(invAb)sgaugaggaUudTggguuuucuas(invAb) | 1145 | GAUGAGGAUUTGGGUUUUCUA | 1427 |
| AM19358-SS | (NAG37)s(invAb)sgaugaggadTuUggguuuucuas(invAb) | 1146 | GAUGAGGATUUGGGUUUUCUA | 1426 |
| AM19544-SS | (NAG37)s(invAb)sugaggaUfuUfGfgguuuucuas(invAb) | 1147 | UGAGGAUUUGGGUUUUCUA | 1408 |
| AM19545-SS | (NAG37)susgaggaUfuUfGfgguuuucuas(invAb) | 1148 | UGAGGAUUUGGGUUUUCUA | 1408 |
| AM19672-SS | (NAG37)s(invAb)sgcugugguGfUfUfugaguacuuas(invAb) | 1149 | GCUGUGGUGUUUGAGUACUUA | 1409 |
| AM19697-SS | (NAG37)s(invAb)sggacccaaUfuAfcugucauugas(invAb) | 1150 | GGACCCAAUUACUGUCAUUGA | 1390 |
| AM19698-SS | (NAG37)s(invAb)sggacccaaUfuAfCfugucauugas(invAb) | 1151 | GGACCCAAUUACUGUCAUUGA | 1390 |
| AM19699-SS | (NAG37)s(invAb)sggacccAfaUfuAfcugucauugas(invAb) | 1152 | GGACCCAAUUACUGUCAUUGA | 1390 |
| AM20010-SS | (NAG37)s(invAb)sugugguGfUfCfugaguacuuus(invAb) | 1153 | UGUGGUGUCUGAGUACUUU | 1410 |
| AM20013-SS | (NAG37)s(invAb)scgugguGfUfCfugaguacuuus(invAb) | 1154 | CGUGGUGUCUGAGUACUUU | 1411 |
| AM20015-SS | (NAG37)s(invAb)sggugguGfUfCfugaguacuuus(invAb) | 1155 | GGUGGUGUCUGAGUACUUU | 1412 |
| AM20020-SS | (NAG37)sgcugugguGfUfCfugaguacuuas(invAb) | 1156 | GCUGUGGUGUCUGAGUACUUA | 1406 |
| AM20068-SS | (NAG37)s(invAb)sggugagGfaUfUfgggguuuucuas(invAb) | 1157 | GGUGAGGAUUUGGGUUUUCUA | 1404 |
| AM20191-SS | (NAG37)sgsgugguGfUfCfugaguacuuus(invAb) | 1158 | GGUGGUGUCUGAGUACUUU | 1412 |
| AM20193-SS | (NAG37)scsgugguGfUfCfugaguacuuus(invAb) | 1159 | CGUGGUGUCUGAGUACUUU | 1411 |
| AM20195-SS | (NAG37)susgugguGfUfCfugaguacuuus(invAb) | 1160 | UGUGGUGUCUGAGUACUUU | 1410 |
| AM20198-SS | (NAG37)sgsgugguGfUfCfugaguacuus(invdA) | 1161 | GGUGGUGUCUGAGUACUUA | 1413 |
| AM20205-SS | (NAG37)s(invAb)sggaggaUfuUfGfgguuuucuas(invAb) | 1162 | GGAGGAUUUGGGUUUUCUA | 1414 |
| AM20207-SS | (NAG37)s(invAb)scgaggaUfuUfGfgguuuucuas(invAb) | 1163 | CGAGGAUUUGGGUUUUCUA | 1415 |
| AM20330-SS | (NAG37)s(invAb)sgcuguaguGfUfCfugaguacuuas(invAb) | 1164 | GCUGUAGUGUCUGAGUACUUA | 1416 |
| AM20331-SS | (NAG37)s(invAb)sgcuaugguGfUfCfugaguacuuas(invAb) | 1165 | GCUAUGGUGUCUGAGUACUUA | 1417 |
| AM20493-SS | (NAG37)s(invAb)sgcugugguGfUfGfugaguacuuas(invAb) | 1166 | GCUGUGGUGUGAGUACUUA | 1418 |
| AM20495-SS | (NAG37)s(invAb)sgcuguuguGfUfGfugaggacuuas(invAb) | 1167 | GCUGUUGUGUGAGGACUUA | 1419 |

TABLE 4A-continued

CFB RNAi Agent Sense Strand Sequences

| Sense Strand ID: | Modified Sense Strand (5' → 3') | SEQ ID NO. | Underlying Base Sequence (5' → 3') (Shown as an Unmodified Nucleotide Sequence) | SEQ ID NO. |
|---|---|---|---|---|
| CS004414 | (NAG37)s(invAb)sacuguggGfUfCfugaguacuuus(invAb) | 1433 | ACUGUGGUGUCUGAGUACUUU | 1438 |
| CS006373 | (NAG37)s(invAb)sgguggGfUfCfugaguacuuas(invAb) | 1434 | GGUGGUGUCUGAGUACUUA | 1413 |

($A^{2N}$) = 2-aminoadenine-containing nucleotide; I = hypoxanthine (inosine) nucleotide

TABLE 4B

CFB RNAi Agent Sense Strand Sequences
(Shown Without Targeting Ligand and Inverted Abasic End Caps)

| Sense Strand ID: | Modified Sense Strand (5' → 3') | SEQ ID NO. | Underlying Base Sequence (5' → 3') (Shown as an Unmodified Nucleotide Sequence) | SEQ ID NO. |
|---|---|---|---|---|
| AM17114-SS-NL | gcaucuacCfUfGfgugcuagaua | 1168 | GCAUCUACCUGGUGCUAGAUA | 1347 |
| AM17116-SS-NL | caucuaccUfGfGfugcuagauga | 1169 | CAUCUACCUGGUGCUAGAUGA | 1348 |
| AM17118-SS-NL | aucuaccuGfGfUfgcuagauiga | 1170 | AUCUACCUGGUGCUAGAUIGA | 1349 |
| AM17120-SS-NL | ucuaccugGfUfGfcuagauigau | 1171 | UCUACCUGGUGCUAGAUIGAU | 1350 |
| AM17122-SS-NL | uaccugguGfCfUfagaugiauca | 1172 | UACCUGGUGCUAGAUGIAUCA | 1351 |
| AM17124-SS-NL | uggugcuaGfAfUfggaucaiaca | 1173 | UGGUGCUAGAUGGAUCAIACA | 1352 |
| AM17126-SS-NL | gcuagaugGfAfUfcagacaicau | 1174 | GCUAGAUGGAUCAGACAICAU | 1353 |
| AM17128-SS-NL | ucucugagUfCfUfcugugicaua | 1175 | UCUCUGAGUCUCUGUGICAUA | 1354 |
| AM17130-SS-NL | gcugugguGfUfCfugaguacuuu | 1176 | GCUGUGGUGUCUGAGUACUUU | 1355 |
| AM17132-SS-NL | cguuucauUfCfAfaguugiugua | 1177 | CGUUUCAUUCAAGUUGIUGUA | 1356 |
| AM17134-SS-NL | gua_2NaucagCfUfGfgggaguagua | 1178 | GUA($A^{2N}$)UCAGCUGGGGAGUAGUA | 1357 |
| AM17136-SS-NL | gaucagcuGfGfGfgaguaguiga | 1179 | GAUCAGCUGGGGAGUAGUIGA | 1358 |
| AM17138-SS-NL | agcuggggAfGfUfagugiaugua | 1180 | AGCUGGGGAGUAGUGIAUGUA | 1359 |
| AM17140-SS-NL | cuggggagUfAfGfuggaugucua | 1181 | CUGGGGAGUAGUGGAUGUCUA | 1360 |
| AM17142-SS-NL | uccaagauGfAfGfgauuugiguu | 1182 | UCCAAGAUGAGGAUUUGIGUU | 1361 |
| AM17144-SS-NL | ccaagaugAfGfGfauuugiguuu | 1183 | CCAAGAUGAGGAUUUGIGUUU | 1362 |
| AM17146-SS-NL | gaugaggaUfUfUfggguuucua | 1184 | GAUGAGGAUUUGGGUUUUCUA | 1363 |
| AM17678-SS-NL | gaugaggaUfuUfUfGfggguuucua | 1185 | GAUGAGGAUUUGGGUUUUCUA | 1363 |
| AM17679-SS-NL | gaugaggaUfuUfgGfguuucua | 1186 | GAUGAGGAUUUGGGUUUUCUA | 1363 |
| AM17680-SS-NL | gaugagGfaUfuUfggguuucua | 1187 | GAUGAGGAUUUGGGUUUUCUA | 1363 |
| AM17682-SS-NL | cacugcuaUfGfAfcgguuacacu | 1188 | CACUGCUAUGACGGUUACACU | 1364 |
| AM17684-SS-NL | gccaaaaaGfUfGfucuagucaaa | 1189 | GCCAAAAAGUGUCUAGUCAAA | 1365 |
| AM17686-SS-NL | ca_2NaaaaguGfUfCfuagucaacuu | 1190 | C($A^{2N}$)AAAAGUGUCUAGUCAACUU | 1366 |
| AM17688-SS-NL | agaaggugGfCfAfaguuauggua | 1191 | AGAAGGUGGCAAGUUAUGGUA | 1367 |
| AM17690-SS-NL | cugauggaUfUfGfcacaacauga | 1192 | CUGAUGGAUUGCACAACAUGA | 1368 |
| AM17692-SS-NL | cccaauuaCfUfGfucauugauga | 1193 | CCCAAUUACUGUCAUUGAUGA | 1369 |
| AM17694-SS-NL | gaaccaagUfGfAfacaucaauga | 1194 | GAACCAAGUGAACAUCAAUGA | 1370 |
| AM17696-SS-NL | gguaccgaUfUfAfccacaaicaa | 1195 | GGUACCGAUUACCACAAICAA | 1371 |

TABLE 4B-continued

CFB RNAi Agent Sense Strand Sequences
(Shown Without Targeting Ligand and Inverted Abasic End Caps)

| Sense Strand ID | Modified Sense Strand (5' → 3') | SEQ ID NO. | Underlying Base Sequence (5' → 3') (Shown as an Unmodified Nucleotide Sequence) | SEQ ID NO. |
|---|---|---|---|---|
| AM17698-SS-NL | caccgauuAfCfCfacaaicaaca | 1196 | CACCGAUUACCACAAICAACA | 1372 |
| AM17700-SS-NL | cauggcagGfCfCfaagaucucaa | 1197 | CAUGGCAGGCCAAGAUCUCAA | 1373 |
| AM17702-SS-NL | gugacguuGfCfCfcugaucaaga | 1198 | GUGACGUUGCCCUGAUCAAGA | 1374 |
| AM17704-SS-NL | ugacguugCfCfCfugaucaaicu | 1199 | UGACGUUGCCCUGAUCAAICU | 1375 |
| AM17706-SS-NL | uacgugugUfCfCfuucugicuua | 1200 | UACGUGUGUCCUUCUGICUUA | 1376 |
| AM17708-SS-NL | ugugagugAfUfGfagaucucuuu | 1201 | UGUGAGUGAUGAGAUCUCUUU | 1377 |
| AM17710-SS-NL | ugagugauGfAfGfaucucuuuca | 1202 | UGAGUGAUGAGAUCUCUUUCA | 1378 |
| AM17712-SS-NL | cugccaagAfCfUfccuucaugua | 1203 | CUGCCAAGACUCCUUCAUGUA | 1379 |
| AM17714-SS-NL | ccaagacuCfCfUfucauguacia | 1204 | CCAAGACUCCUUCAUGUACIA | 1380 |
| AM17716-SS-NL | agacuccuUfCfAfuguacacaa | 1205 | AGACUCCUUCAUGUACIACAA | 1381 |
| AM17718-SS-NL | gagaccauAfGfAfaggaiucgau | 1206 | GAGACCAUAGAAGGAIUCGAU | 1382 |
| AM17720-SS-NL | gcuccaugAfAfCfaucuaccuia | 1207 | GCUCCAUGAACAUCUACCUIA | 1383 |
| AM17722-SS-NL | gaacaucuAfCfCfugguicuaga | 1208 | GAACAUCUACCUGGUICUAGA | 1384 |
| AM17724-SS-NL | guggaucaGfAfCfagcauugiga | 1209 | GUGGAUCAGACAGCAUUGIGA | 1385 |
| AM17726-SS-NL | gagccaaaAfAfGfugucuaiuca | 1210 | GAGCCAAAAAGUGUCUAIUCA | 1386 |
| AM17728-SS-NL | gagaagguGfGfCfaaguuauggu | 1211 | GAGAAGGUGGCAAGUUAUGGU | 1387 |
| AM17730-SS-NL | gaguuaugGfUfGfugaaiccaaa | 1212 | GAGUUAUGGUGUGAAICCAAA | 1388 |
| AM17732-SS-NL | aggcaguGfUfAfCfagcaugauga | 1213 | AGGCAGUGUACAGCAUGAUGA | 1389 |
| AM17734-SS-NL | ggacccaaUfUfAfcugucauuga | 1214 | GGACCCAAUUACUGUCAUUGA | 1390 |
| AM17736-SS-NL | gacccaauUfAfCfugucauugau | 1215 | GACCCAAUUACUGUCAUUGAU | 1391 |
| AM17738-SS-NL | cacugucaUfUfGfaugaiaucca | 1216 | CACUGUCAUUGAUGAIAUCCA | 1392 |
| AM17740-SS-NL | ggaggauuAfUfCfuggaugucua | 1217 | GGAGGAUUAUCUGGAUGUCUA | 1393 |
| AM17742-SS-NL | caucuggaUfGfUfcuaugguuuu | 1218 | CAUCUGGAUGUCUAUGUGUUU | 1394 |
| AM17744-SS-NL | ucuggaugUfCfUfaugugunuga | 1219 | UCUGGAUGUCUAUGUGUUUGA | 1395 |
| AM17746-SS-NL | ccaagugaAfCfAfucaaugcuuu | 1220 | CCAAGUGAACAUCAAUGCUUU | 1396 |
| AM17748-SS-NL | gugaacauCfAfAfugcuuugicu | 1221 | GUGAACAUCAAUGCUUUGICU | 1397 |
| AM17750-SS-NL | gaacaucaAfUfGfcuuugicuua | 1222 | GAACAUCAAUGCUUUGICUUA | 1398 |
| AM17752-SS-NL | caagaaagAfCfAfaugaicaaca | 1223 | CAAGAAAGACAAUGAICAACA | 1399 |
| AM17754-SS-NL | ga_2NaagacaAfUfGfagcaacaugu | 1224 | G(A$^{2N}$)AAGACAAUGAGCAACAUGU | 1400 |
| AM17756-SS-NL | ggugucugAfGfUfacuuuguicu | 1225 | GGUGUCUGAGUACUUUGUICU | 1401 |
| AM17758-SS-NL | gugucugaGfUfAfcuuuguicua | 1226 | GUGUCUGAGUACUUUGUICUA | 1402 |
| AM17760-SS-NL | gcugacagCfAfGfcacauuguuu | 1227 | GCUGACAGCAGCACAUUGUUU | 1403 |
| AM17773-SS-NL | gcugugguGfuCfUfgaguacuuu | 1228 | GCUGUGGUGUCUGAGUACUUU | 1355 |
| AM17774-SS-NL | gcugugguGfuCfuGfaguacuuu | 1229 | GCUGUGGUGUCUGAGUACUUU | 1355 |
| AM17775-SS-NL | gcugugGfuCfuCfugaguacuuu | 1230 | GCUGUGGUGUCUGAGUACUUU | 1355 |
| AM19042-SS-NL | gaugaggaUfuuGfgguuuucua | 1231 | GAUGAGGAUUUGGGUUUUCUA | 1363 |

TABLE 4B-continued

CFB RNAi Agent Sense Strand Sequences
(Shown Without Targeting Ligand and Inverted Abasic End Caps)

| Sense Strand ID: | Modified Sense Strand (5' → 3') | SEQ ID NO. | Underlying Base Sequence (5' → 3') (Shown as an Unmodified Nucleotide Sequence) | SEQ ID NO. |
|---|---|---|---|---|
| AM19043-SS-NL | gaugaggadTuudGgguuuucua | 1232 | GAUGAGGAUUUGGGUUUUCUA | 1426 |
| AM19044-SS-NL | ggugaggaUfuUfGfgguuuucua | 1233 | GGUGAGGAUUUGGGUUUUCUA | 1404 |
| AM19046-SS-NL | gcugaggaUfuUfGfgguuuucua | 1234 | GCUGAGGAUUUGGGUUUUCUA | 1405 |
| AM19110-SS-NL | gcugugguGfUfCfugaguacuua | 1235 | GCUGUGGUGUCUGAGUACUUA | 1406 |
| AM19117-SS-NL | gcuguggudGudCugaguacuuu | 1236 | GCUGUGGUGUCUGAGUACUUU | 1355 |
| AM19216-SS-NL | agaugaggAfUfUfuggguuuucu | 1237 | AGAUGAGGAUUUGGGUUUUCU | 1407 |
| AM19351-SS-NL | gaugaggaUfuUfgguuuucua | 1238 | GAUGAGGAUUUGGGUUUUCUA | 1363 |
| AM19352-SS-NL | gaugaggaUuUfgguuuucua | 1239 | GAUGAGGAUUUGGGUUUUCUA | 1363 |
| AM19353-SS-NL | gaugaggaUfuUgguuuucua | 1240 | GAUGAGGAUUUGGGUUUUCUA | 1363 |
| AM19354-SS-NL | gaugaggadTuUfgguuuucua | 1241 | GAUGAGGAUUUGGGUUUUCUA | 1426 |
| AM19355-SS-NL | gaugaggaUfudTgguuuucua | 1242 | GAUGAGGAUUUGGGUUUUCUA | 1427 |
| AM19356-SS-NL | gaugaggadTudTgguuuucua | 1243 | GAUGAGGAUUUGGGUUUUCUA | 1428 |
| AM19357-SS-NL | gaugaggaUudTgguuuucua | 1244 | GAUGAGGAUUUGGGUUUUCUA | 1427 |
| AM19358-SS-NL | gaugaggadTuUgguuuucua | 1245 | GAUGAGGAUUUGGGUUUUCUA | 1426 |
| AM19544-SS-NL | ugaggaUfuUfGfgguuuucua | 1246 | UGAGGAUUUGGGUUUUCUA | 1408 |
| AM19545-SS-NL | usgaggaUfuUfGfgguuuucua | 1247 | UGAGGAUUUGGGUUUUCUA | 1408 |
| AM19672-SS-NL | gcugugguGfUfUfugaguacuua | 1248 | GCUGUGGUGUUUGAGUACUUA | 1409 |
| AM19697-SS-NL | ggacccaaUfuAfcugucauuga | 1249 | GGACCCAAUUACUGUCAUUGA | 1390 |
| AM19698-SS-NL | ggacccaaUfuAfCfugucauuga | 1250 | GGACCCAAUUACUGUCAUUGA | 1390 |
| AM19699-SS-NL | ggacccAfaUfAfcugucauuga | 1251 | GGACCCAAUUACUGUCAUUGA | 1390 |
| AM20010-SS-NL | uguggguGfUfCfugaguacuuu | 1252 | UGUGGUGUCUGAGUACUUU | 1410 |
| AM20013-SS-NL | cguggguGfUfCfugaguacuuu | 1253 | CGUGGUGUCUGAGUACUUU | 1411 |
| AM20015-SS-NL | gguggguGfUfCfugaguacuuu | 1254 | GGUGGUGUCUGAGUACUUU | 1412 |
| AM20020-SS-NL | gcuguggguGfUfCfugaguacuua | 1255 | GCUGUGGUGUCUGAGUACUUA | 1406 |
| AM20068-SS-NL | ggugagGfaUfUfgguuuucua | 1256 | GGUGAGGAUUUGGGUUUUCUA | 1404 |
| AM20191-SS-NL | gsguggguGfUfCfugaguacuuu | 1257 | GGUGGUGUCUGAGUACUUU | 1412 |
| AM20193-SS-NL | csguggguGfUfCfugaguacuuu | 1258 | CGUGGUGUCUGAGUACUUU | 1411 |
| AM20195-SS-NL | usguggguGfUfCfugaguacuuu | 1259 | UGUGGUGUCUGAGUACUUU | 1410 |
| AM20198-SS-NL | gsguggguGfUfCfugaguacuu | 1260 | GGUGGUGUCUGAGUACUUA | 1413 |
| AM20205-SS-NL | ggaggaUfuUfGfgguuuucua | 1261 | GGAGGAUUUGGGUUUUCUA | 1414 |
| AM20207-SS-NL | cgaggaUfuUfGfgguuuucua | 1262 | CGAGGAUUUGGGUUUUCUA | 1415 |
| AM20330-SS-NL | gcuguaguGfUfCfugaguacuua | 1263 | GCUGUAGUGUCUGAGUACUUA | 1416 |
| AM20331-SS-NL | gcuaugguGfUfCfugaguacuua | 1264 | GCUAUGGUGUCUGAGUACUUA | 1417 |
| AM20493-SS-NL | gcugugguGfUfGfugaguacuua | 1265 | GCUGUGGUGUGUGAGUACUUA | 1418 |
| AM20495-SS-NL | gcuguuguGfUfGfugaggacuua | 1266 | GCUGUUGUGUGUGAGGACUUA | 1419 |

TABLE 4B-continued

CFB RNAi Agent Sense Strand Sequences
(Shown Without Targeting Ligand and Inverted Abasic End Caps)

| Sense Strand ID: | Modified Sense Strand (5' → 3') | SEQ ID NO. | Underlying Base Sequence (5' → 3') (Shown as an Unmodified Nucleotide Sequence) | SEQ ID NO. |
|---|---|---|---|---|
| CS004414-NL | acugugguGfUfCfugaguacuuu | 1435 | ACUGUGGUGUCUGAGUACUUU | 1438 |
| CS006373-NL | ggugguGfUfCfugaguacuua | 1436 | GGUGGUGUCUGAGUACUUA | 1413 |

($A^{2N}$) = 2-aminoadenine-containing nucleotide; I = hypoxanthine (inosine) nucleotide The CFB RNAi agents described herein are formed by annealing an antisense strand with a sense strand. A sense strand containing a sequence listed in Table 2, Table 4A, Table 4B, or Table 5C can be hybridized to any antisense strand containing a sequence listed in Table 2, Table 3, or Table 5C provided the two sequences have a region of at least 85% complementarity over a contiguous 15, 16, 17, 18, 19, 20, or 21 nucleotide sequence.

In some embodiments, the antisense strand of a CFB RNAi agent disclosed herein differs by 0, 1, 2, or 3 nucleotides from any of the antisense strand sequences in Table 3 or Table 5C. In some embodiments, the sense strand of a CFB RNAi agent disclosed herein differs by 0, 1, 2, or 3 nucleotides from any of the sense strand sequences in Table 4A, Table 4B, or Table 5C.

In some embodiments, a CFB RNAi agent antisense strand comprises a nucleotide sequence of any of the sequences in Table 2, Table 3, or Table 5C. In some embodiments, a CFB RNAi agent antisense strand comprises the sequence of nucleotides (from 5' end→3' end) 1-17, 2-17, 1-18, 2-18, 1-19, 2-19, 1-20, 2-20, 1-21, or 2-21, of any of the sequences in Table 2, Table 3, or Table 5C. In certain embodiments, a CFB RNAi agent antisense strand comprises or consists of a modified sequence of any one of the modified sequences in Table 3 or Table 5C.

In some embodiments, a CFB RNAi agent sense strand comprises the nucleotide sequence of any of the sequences in Table 2, Table 4A, Table 4B or Table 5C. In some embodiments, a CFB RNAi agent sense strand comprises the sequence of nucleotides (from 5' end→3' end) 1-17, 2-17, 3-17, 4-17, 1-18, 2-18, 3-18, 4-18, 1-19, 2-19, 3-19, 4-19, 1-20, 2-20, 3-20, 4-20, 1-21, 2-21, 3-21, or 4-21, of any of the sequences in Table 2, Table 4A, Table 4B or Table 5C. In certain embodiments, a CFB RNAi agent sense strand comprises or consists of a modified sequence of any one of the modified sequences in Table 4A, Table 4B or Table 5C.

For the CFB RNAi agents disclosed herein, the nucleotide at position 1 of the antisense strand (from 5' end→3' end) can be perfectly complementary to a CFB gene, or can be non-complementary to a CFB gene. In some embodiments, the nucleotide at position 1 of the antisense strand (from 5' end→3' end) is a U, A, or dT (or a modified version thereof). In some embodiments, the nucleotide at position 1 of the antisense strand (from 5' end→3' end) forms an A:U or U:A base pair with the sense strand.

A sense strand containing a sequence listed in Table 2, Table 4A, Table 4B, or Table 5C can be hybridized to any antisense strand containing a sequence listed in Table 2, Table 3, or Table 5C provided the two sequences have a region of at least 85% complementarity over a contiguous 15, 16, 17, 18, 19, 20, or 21 nucleotide sequence. In some embodiments, the CFB RNAi agent has a sense strand consisting of the modified sequence of any of the modified sequences in Table 4A, Table 4B, or Table 5C, and an antisense strand consisting of the modified sequence of any of the modified sequences in Table 3 or Table 5C. Certain representative sequence pairings are exemplified by the Duplex ID Nos. shown in Tables 5A, 5B, and 5C.

In some embodiments, a CFB RNAi agent comprises, consists of, or consists essentially of a duplex represented by any one of the Duplex ID Nos. presented herein. In some embodiments, a CFB RNAi agent comprises the sense strand and antisense strand nucleotide sequences of any of the duplexes represented by any of the Duplex ID Nos. presented herein. In some embodiments, a CFB RNAi agent comprises the sense strand and antisense strand nucleotide sequences of any of the duplexes represented by any of the Duplex ID Nos. presented herein and a targeting group and/or linking group wherein the targeting group and/or linking group is covalently linked (i.e., conjugated) to the sense strand or the antisense strand. In some embodiments, a CFB RNAi agent includes the sense strand and antisense strand modified nucleotide sequences of any of the Duplex ID Nos. presented herein. In some embodiments, a CFB RNAi agent comprises the sense strand and antisense strand modified nucleotide sequences of any of the Duplex ID Nos. presented herein and a targeting group and/or linking group, wherein the targeting group and/or linking group is covalently linked to the sense strand or the antisense strand.

In some embodiments, a CFB RNAi agent comprises an antisense strand and a sense strand having the nucleotide sequences of any of the antisense strand/sense strand duplexes of Table 2 or Tables 5A, 5B, and 5C, and further comprises a targeting group or targeting ligand. In some embodiments, a CFB RNAi agent comprises an antisense strand and a sense strand having the nucleotide sequences of any of the antisense strand/sense strand duplexes of Table 2 or Tables 5A, 5B, and 5C, and further comprises an asialoglycoprotein receptor ligand targeting group.

A targeting group, with or without a linker, can be linked to the 5' or 3' end of any of the sense and/or antisense strands disclosed in Tables 2, 3, 4, or 5C. A linker, with or without a targeting group, can be attached to the 5' or 3' end of any of the sense and/or antisense strands disclosed in Tables 2, 3, 4, and 5C.

In some embodiments, a CFB RNAi agent comprises an antisense strand and a sense strand having the nucleotide sequences of any of the antisense strand/sense strand duplexes of Table 2 or Tables 5A, 5B and 5C, and further comprises a targeting ligand selected from the group consisting of: (NAG37) and (NAG37)s, each as defined in Table 6.

In some embodiments, a CFB RNAi agent comprises an antisense strand and a sense strand having the modified nucleotide sequence of any of the antisense strand and/or sense strand nucleotide sequences in Table 3 or Table 4A or Table 4B.

In some embodiments, a CFB RNAi agent comprises an antisense strand and a sense strand having a modified nucleotide sequence of any of the antisense strand and/or sense strand nucleotide sequences of any of the duplexes of Tables 5A, 5B3, and 5C, and further comprises an asialoglycoprotein receptor ligand targeting group.

In some embodiments, a CFB RNAi agent comprises, consists of, or consists essentially of any of the duplexes of Tables 5A, 5B3, and 5C.

TABLE 5A

CFB RNAi Agents Duplexes with Corresponding Sense and Antisense Strand ID Numbers and Sequence ID numbers for the modified and unmodified nucleotide sequences.

| Duplex | AS ID | AS modified SEQ ID NO: | AS unmodified SEQ ID NO: | SS ID | SS modified SEQ ID NO: | SS unmodified SEQ ID NO: |
|---|---|---|---|---|---|---|
| AD12080 | AM17115-AS | 897 | 1267 | AM17114-SS | 1069 | 1347 |
| AD12081 | AM17117-AS | 898 | 1268 | AM17116-SS | 1070 | 1348 |
| AD12082 | AM17119-AS | 899 | 1269 | AM17118-SS | 1071 | 1349 |
| AD12083 | AM17121-AS | 900 | 1270 | AM17120-SS | 1072 | 1350 |
| AD12084 | AM17123-AS | 901 | 1271 | AM17122-SS | 1073 | 1351 |
| AD12085 | AM17125-AS | 902 | 1272 | AM17124-SS | 1074 | 1352 |
| AD12086 | AM17127-AS | 903 | 1273 | AM17126-SS | 1075 | 1353 |
| AD12087 | AM17129-AS | 904 | 1274 | AM17128-SS | 1076 | 1354 |
| AD12088 | AM17131-AS | 905 | 1275 | AM17130-SS | 1077 | 1355 |
| AD12089 | AM17133-AS | 906 | 1276 | AM17132-SS | 1078 | 1356 |
| AD12090 | AM17135-AS | 907 | 1277 | AM17134-SS | 1079 | 1357 |
| AD12091 | AM17137-AS | 908 | 1278 | AM17136-SS | 1080 | 1358 |
| AD12092 | AM17139-AS | 909 | 1279 | AM17138-SS | 1081 | 1359 |
| AD12093 | AM17141-AS | 910 | 1280 | AM17140-SS | 1083 | 1360 |
| AD12094 | AM17143-AS | 911 | 1281 | AM17142-SS | 1083 | 1361 |
| AD12095 | AM17145-AS | 912 | 1282 | AM17144-SS | 1084 | 1362 |
| AD12096 | AM17147-AS | 913 | 1283 | AM17146-SS | 1085 | 1363 |
| AD12495 | AM17667-AS | 914 | 1283 | AM17146-SS | 1085 | 1363 |
| AD12496 | AM17668-AS | 915 | 1283 | AM17146-SS | 1085 | 1363 |
| AD12497 | AM17669-AS | 916 | 1283 | AM17146-SS | 1085 | 1363 |
| AD12498 | AM17670-AS | 917 | 1283 | AM17146-SS | 1085 | 1363 |
| AD12499 | AM17671-AS | 918 | 1283 | AM17146-SS | 1085 | 1363 |
| AD12500 | AM17672-AS | 919 | 1283 | AM17146-SS | 1085 | 1363 |
| AD12501 | AM17673-AS | 920 | 1283 | AM17146-SS | 1085 | 1363 |
| AD12502 | AM17674-AS | 921 | 1283 | AM17146-SS | 1085 | 1363 |
| AD12503 | AM17675-AS | 922 | 1283 | AM17146-SS | 1085 | 1363 |
| AD12504 | AM17676-AS | 923 | 1283 | AM17146-SS | 1085 | 1363 |
| AD12505 | AM17677-AS | 1429 | 1283 | AM17146-SS | 1085 | 1363 |
| AD12506 | AM17667-AS | 914 | 1283 | AM17678-SS | 1086 | 1363 |
| AD12507 | AM17667-AS | 914 | 1283 | AM17679-SS | 1087 | 1363 |
| AD12508 | AM17667-AS | 914 | 1283 | AM17680-SS | 1088 | 1363 |
| AD12509 | AM17681-AS | 924 | 1283 | AM17146-SS | 1085 | 1363 |
| AD12510 | AM17683-AS | 925 | 1284 | AM17682-SS | 1089 | 1364 |
| AD12511 | AM17685-AS | 926 | 1285 | AM17684-SS | 1090 | 1365 |
| AD12512 | AM17687-AS | 927 | 1286 | AM17686-SS | 1091 | 1366 |
| AD12513 | AM17689-AS | 928 | 1287 | AM17688-SS | 1092 | 1367 |
| AD12514 | AM17691-AS | 929 | 1288 | AM17690-SS | 1093 | 1368 |
| AD12515 | AM17693-AS | 930 | 1289 | AM17692-SS | 1094 | 1369 |
| AD12516 | AM17695-AS | 931 | 1290 | AM17694-SS | 1095 | 1370 |
| AD12517 | AM17697-AS | 932 | 1291 | AM17696-SS | 1096 | 1371 |
| AD12518 | AM17699-AS | 933 | 1292 | AM17698-SS | 1097 | 1372 |
| AD12519 | AM17701-AS | 934 | 1293 | AM17700-SS | 1098 | 1373 |
| AD12520 | AM17703-AS | 935 | 1294 | AM17702-SS | 1099 | 1374 |
| AD12521 | AM17705-AS | 936 | 1295 | AM17704-SS | 1100 | 1375 |
| AD12522 | AM17707-AS | 937 | 1296 | AM17706-SS | 1101 | 1376 |
| AD12523 | AM17709-AS | 938 | 1297 | AM17708-SS | 1102 | 1377 |
| AD12524 | AM17711-AS | 939 | 1298 | AM17710-SS | 1103 | 1378 |
| AD12525 | AM17713-AS | 940 | 1299 | AM17712-SS | 1104 | 1379 |
| AD12526 | AM17715-AS | 941 | 1300 | AM17714-SS | 1105 | 1380 |
| AD12527 | AM17717-AS | 942 | 1301 | AM17716-SS | 1106 | 1381 |
| AD12528 | AM17719-AS | 943 | 1302 | AM17718-SS | 1107 | 1382 |
| AD12529 | AM17721-AS | 944 | 1303 | AM17720-SS | 1108 | 1383 |
| AD12530 | AM17723-AS | 945 | 1304 | AM17722-SS | 1109 | 1384 |
| AD12531 | AM17725-AS | 946 | 1305 | AM17724-SS | 1110 | 1385 |
| AD12532 | AM17727-AS | 947 | 1306 | AM17726-SS | 1111 | 1386 |
| AD12533 | AM17729-AS | 948 | 1307 | AM17728-SS | 1112 | 1387 |
| AD12534 | AM17731-AS | 949 | 1308 | AM17730-SS | 1113 | 1388 |
| AD12535 | AM17733-AS | 950 | 1309 | AM17732-SS | 1114 | 1389 |
| AD12536 | AM17735-AS | 951 | 1310 | AM17734-SS | 1115 | 1390 |
| AD12537 | AM17737-AS | 952 | 1311 | AM17736-SS | 1116 | 1391 |
| AD12538 | AM17739-AS | 953 | 1312 | AM17738-SS | 1117 | 1392 |
| AD12539 | AM17741-AS | 954 | 1313 | AM17740-SS | 1118 | 1393 |
| AD12540 | AM17743-AS | 955 | 1314 | AM17742-SS | 1119 | 1394 |

TABLE 5A-continued

CFB RNAi Agents Duplexes with Corresponding Sense and
Antisense Strand ID Numbers and Sequence ID numbers for
the modified and unmodified nucleotide sequences.

| Duplex | AS ID | AS modified SEQ ID NO: | AS unmodified SEQ ID NO: | SS ID | SS modified SEQ ID NO: | SS unmodified SEQ ID NO: |
|---|---|---|---|---|---|---|
| AD12541 | AM17745-AS | 956 | 1315 | AM17744-SS | 1120 | 1395 |
| AD12542 | AM17747-AS | 957 | 1316 | AM17746-SS | 1121 | 1396 |
| AD12543 | AM17749-AS | 958 | 1317 | AM17748-SS | 1122 | 1397 |
| AD12544 | AM17751-AS | 959 | 1318 | AM17750-SS | 1123 | 1398 |
| AD12545 | AM17753-AS | 960 | 1319 | AM17752-SS | 1124 | 1399 |
| AD12546 | AM17755-AS | 961 | 1320 | AM17754-SS | 1125 | 1400 |
| AD12547 | AM17757-AS | 962 | 1321 | AM17756-SS | 1126 | 1401 |
| AD12548 | AM17759-AS | 963 | 1322 | AM17758-SS | 1127 | 1402 |
| AD12549 | AM17761-AS | 964 | 1323 | AM17760-SS | 1128 | 1403 |
| AD12550 | AM17762-AS | 965 | 1275 | AM17130-SS | 1077 | 1355 |
| AD12551 | AM17763-AS | 966 | 1275 | AM17130-SS | 1077 | 1355 |
| AD12552 | AM17764-AS | 967 | 1275 | AM17130-SS | 1077 | 1355 |
| AD12553 | AM17765-AS | 968 | 1275 | AM17130-SS | 1077 | 1355 |
| AD12554 | AM17766-AS | 969 | 1275 | AM17130-SS | 1077 | 1355 |
| AD12555 | AM17767-AS | 970 | 1275 | AM17130-SS | 1077 | 1355 |
| AD12556 | AM17768-AS | 971 | 1275 | AM17130-SS | 1077 | 1355 |
| AD12557 | AM17769-AS | 972 | 1275 | AM17130-SS | 1077 | 1355 |
| AD12558 | AM17770-AS | 973 | 1275 | AM17130-SS | 1077 | 1355 |
| AD12559 | AM17771-AS | 974 | 1275 | AM17130-SS | 1077 | 1355 |
| AD12560 | AM17772-AS | 975 | 1275 | AM17130-SS | 1077 | 1355 |
| AD12561 | AM17762-AS | 965 | 1275 | AM17773-SS | 1129 | 1355 |
| AD12562 | AM17762-AS | 965 | 1275 | AM17774-SS | 1130 | 1355 |
| AD12563 | AM17762-AS | 965 | 1275 | AM17775-SS | 1131 | 1355 |
| AD12564 | AM17776-AS | 976 | 1275 | AM17130-SS | 1077 | 1355 |
| AD12964 | AM17668-AS | 915 | 1283 | AM17678-SS | 1086 | 1363 |
| AD12965 | AM17674-AS | 921 | 1283 | AM17678-SS | 1086 | 1363 |
| AD12966 | AM17668-AS | 915 | 1283 | AM17680-SS | 1088 | 1363 |
| AD12967 | AM17674-AS | 921 | 1283 | AM17680-SS | 1088 | 1363 |
| AD12968 | AM18396-AS | 977 | 1283 | AM17678-SS | 1086 | 1363 |
| AD12969 | AM18397-AS | 978 | 1283 | AM17678-SS | 1086 | 1363 |
| AD12970 | AM18396-AS | 977 | 1283 | AM17680-SS | 1088 | 1363 |
| AD12971 | AM18397-AS | 978 | 1283 | AM17680-SS | 1088 | 1363 |
| AD13036 | AM17765-AS | 968 | 1275 | AM17775-SS | 1131 | 1355 |
| AD13037 | AM17770-AS | 973 | 1275 | AM17775-SS | 1131 | 1355 |
| AD13038 | AM18482-AS | 979 | 1275 | AM17775-SS | 1131 | 1355 |
| AD13039 | AM18483-AS | 980 | 1275 | AM17775-SS | 1131 | 1355 |
| AD13040 | AM18484-AS | 981 | 1275 | AM17775-SS | 1131 | 1355 |
| AD13041 | AM18485-AS | 982 | 1275 | AM17775-SS | 1131 | 1355 |
| AD13123 | AM17764-AS | 967 | 1275 | AM17775-SS | 1131 | 1355 |
| AD13124 | AM17771-AS | 974 | 1275 | AM17775-SS | 1131 | 1355 |
| AD13125 | AM18618-AS | 983 | 1275 | AM17775-SS | 1131 | 1355 |
| AD13126 | AM18618-AS | 983 | 1275 | AM17130-SS | 1077 | 1355 |
| AD13127 | AM18619-AS | 984 | 1275 | AM17130-SS | 1077 | 1355 |
| AD13128 | AM18619-AS | 984 | 1275 | AM17775-SS | 1131 | 1355 |
| AD13382 | AM19035-AS | 985 | 1420 | AM17678-SS | 1086 | 1363 |
| AD13383 | AM19036-AS | 986 | 1283 | AM17678-SS | 1086 | 1363 |
| AD13384 | AM19037-AS | 987 | 1283 | AM17678-SS | 1086 | 1363 |
| AD13385 | AM19038-AS | 988 | 1283 | AM17678-SS | 1086 | 1363 |
| AD13386 | AM19039-AS | 989 | 1283 | AM17678-SS | 1086 | 1363 |
| AD13387 | AM19040-AS | 990 | 1421 | AM17678-SS | 1086 | 1363 |
| AD13388 | AM19041-AS | 991 | 1420 | AM17678-SS | 1086 | 1363 |
| AD13389 | AM19039-AS | 989 | 1283 | AM19042-SS | 1132 | 1363 |
| AD13390 | AM19039-AS | 989 | 1283 | AM19043-SS | 1133 | 1426 |
| AD13391 | AM19045-AS | 992 | 1324 | AM19044-SS | 1134 | 1404 |
| AD13392 | AM19047-AS | 993 | 1325 | AM19046-SS | 1135 | 1405 |
| AD13435 | AM18484-AS | 981 | 1275 | AM17130-SS | 1077 | 1355 |
| AD13436 | AM19111-AS | 994 | 1326 | AM19110-SS | 1136 | 1406 |
| AD13437 | AM19112-AS | 995 | 1275 | AM17130-SS | 1077 | 1355 |
| AD13438 | AM19113-AS | 996 | 1275 | AM17130-SS | 1077 | 1355 |
| AD13439 | AM19114-AS | 997 | 1275 | AM17130-SS | 1077 | 1355 |
| AD13440 | AM19115-AS | 998 | 1275 | AM17130-SS | 1077 | 1355 |
| AD13441 | AM19116-AS | 999 | 1275 | AM17130-SS | 1077 | 1355 |
| AD13442 | AM18618-AS | 983 | 1275 | AM19117-SS | 1137 | 1355 |
| AD13443 | AM19118-AS | 1000 | 1275 | AM17130-SS | 1077 | 1355 |
| AD13534 | AM19217-AS | 1001 | 1327 | AM19216-SS | 1138 | 1407 |
| AD13585 | AM19273-AS | 1002 | 1283 | AM17678-SS | 1086 | 1363 |
| AD13586 | AM19274-AS | 1003 | 1275 | AM17130-SS | 1077 | 1355 |
| AD13616 | AM19316-AS | 1004 | 1420 | AM17678-SS | 1086 | 1363 |
| AD13647 | AM19348-AS | 1005 | 1283 | AM17678-SS | 1086 | 1363 |
| AD13648 | AM19349-AS | 1006 | 1283 | AM17678-SS | 1086 | 1363 |
| AD13649 | AM19350-AS | 1007 | 1283 | AM17678-SS | 1086 | 1363 |

TABLE 5A-continued

CFB RNAi Agents Duplexes with Corresponding Sense and
Antisense Strand ID Numbers and Sequence ID numbers for
the modified and unmodified nucleotide sequences.

| Duplex | AS ID | AS modified SEQ ID NO: | AS unmodified SEQ ID NO: | SS ID | SS modified SEQ ID NO: | SS unmodified SEQ ID NO: |
|---|---|---|---|---|---|---|
| AD13650 | AM19040-AS | 1008 | 1421 | AM19351-SS | 1139 | 1363 |
| AD13651 | AM19040-AS | 1008 | 1421 | AM19352-SS | 1140 | 1363 |
| AD13652 | AM19040-AS | 1008 | 1421 | AM19353-SS | 1141 | 1363 |
| AD13653 | AM19040-AS | 1008 | 1421 | AM19354-SS | 1142 | 1426 |
| AD13654 | AM19040-AS | 1008 | 1421 | AM19355-SS | 1143 | 1427 |
| AD13655 | AM19040-AS | 1008 | 1421 | AM19356-SS | 1144 | 1428 |
| AD13656 | AM19040-AS | 1008 | 1421 | AM19357-SS | 1145 | 1427 |
| AD13657 | AM19040-AS | 1008 | 1421 | AM19358-SS | 1146 | 1426 |
| AD13816 | AM19543-AS | 1009 | 1328 | AM17678-SS | 1086 | 1363 |
| AD13817 | AM19543-AS | 1009 | 1328 | AM19544-SS | 1147 | 1408 |
| AD13818 | AM17668-AS | 915 | 1283 | AM19544-SS | 1147 | 1408 |
| AD13819 | AM19543-AS | 1009 | 1328 | AM19545-SS | 1148 | 1408 |
| AD13930 | AM19667-AS | 1010 | 1329 | AM19110-SS | 1136 | 1406 |
| AD13931 | AM19668-AS | 1011 | 1330 | AM19110-SS | 1136 | 1406 |
| AD13932 | AM19669-AS | 1012 | 1331 | AM19110-SS | 1136 | 1406 |
| AD13933 | AM19670-AS | 1013 | 1332 | AM19110-SS | 1136 | 1406 |
| AD13934 | AM19671-AS | 1014 | 1333 | AM19110-SS | 1136 | 1406 |
| AD13935 | AM19111-AS | 994 | 1326 | AM19672-SS | 1149 | 1409 |
| AD13946 | AM19688-AS | 1015 | 1310 | AM17734-SS | 1115 | 1390 |
| AD13947 | AM19689-AS | 1016 | 1310 | AM17734-SS | 1115 | 1390 |
| AD13948 | AM19690-AS | 1017 | 1310 | AM17734-SS | 1115 | 1390 |
| AD13949 | AM19691-AS | 1018 | 1310 | AM17734-SS | 1115 | 1390 |
| AD13950 | AM19692-AS | 1019 | 1310 | AM17734-SS | 1115 | 1390 |
| AD13951 | AM19693-AS | 1020 | 1310 | AM17734-SS | 1115 | 1390 |
| AD13952 | AM19694-AS | 1021 | 1310 | AM17734-SS | 1115 | 1390 |
| AD13953 | AM19695-AS | 1022 | 1310 | AM17734-SS | 1115 | 1390 |
| AD13954 | AM19696-AS | 1023 | 1310 | AM17734-SS | 1115 | 1390 |
| AD13955 | AM19695-AS | 1022 | 1310 | AM19697-SS | 1150 | 1390 |
| AD13956 | AM19695-AS | 1022 | 1310 | AM19698-SS | 1151 | 1390 |
| AD13957 | AM19695-AS | 1022 | 1310 | AM19699-SS | 1152 | 1390 |
| AD13958 | AM19700-AS | 1024 | 1422 | AM17734-SS | 1115 | 1390 |
| AD14126 | AM19894-AS | 1025 | 1420 | AM17678-SS | 1086 | 1363 |
| AD14127 | AM19895-AS | 1026 | 1420 | AM17678-SS | 1086 | 1363 |
| AD14128 | AM19896-AS | 1027 | 1283 | AM17678-SS | 1086 | 1363 |
| AD14129 | AM19897-AS | 1028 | 1283 | AM17678-SS | 1086 | 1363 |
| AD14130 | AM19898-AS | 1029 | 1283 | AM17678-SS | 1086 | 1363 |
| AD14160 | AM19928-AS | 1030 | 1334 | AM17678-SS | 1086 | 1363 |
| AD14221 | AM20011-AS | 1031 | 1335 | AM20010-SS | 1153 | 1410 |
| AD14222 | AM18618-AS | 983 | 1275 | AM20010-SS | 1153 | 1410 |
| AD14223 | AM20012-AS | 1032 | 1275 | AM20010-SS | 1153 | 1410 |
| AD14224 | AM20014-AS | 1033 | 1336 | AM20013-SS | 1154 | 1411 |
| AD14225 | AM20016-AS | 1034 | 1337 | AM20015-SS | 1155 | 1412 |
| AD14226 | AM19670-AS | 1013 | 1332 | AM19672-SS | 1149 | 1409 |
| AD14227 | AM19671-AS | 1014 | 1333 | AM19672-SS | 1149 | 1409 |
| AD14230 | AM19671-AS | 1014 | 1333 | AM20020-SS | 1156 | 1406 |
| AD14231 | AM20021-AS | 1035 | 1333 | AM19110-SS | 1136 | 1406 |
| AD14232 | AM20022-AS | 1036 | 1333 | AM19110-SS | 1136 | 1406 |
| AD14233 | AM20023-AS | 1037 | 1333 | AM19110-SS | 1136 | 1406 |
| AD14234 | AM20024-AS | 1038 | 1423 | AM19110-SS | 1136 | 1406 |
| AD14235 | AM20025-AS | 1039 | 1333 | AM19110-SS | 1136 | 1406 |
| AD14270 | AM20062-AS | 1040 | 1283 | AM17678-SS | 1086 | 1363 |
| AD14271 | AM20063-AS | 1041 | 1324 | AM19044-SS | 1134 | 1404 |
| AD14272 | AM20064-AS | 1042 | 1283 | AM17678-SS | 1086 | 1363 |
| AD14273 | AM20065-AS | 1043 | 1283 | AM17678-SS | 1086 | 1363 |
| AD14274 | AM20066-AS | 1044 | 1324 | AM19044-SS | 1134 | 1404 |
| AD14275 | AM20067-AS | 1045 | 1283 | AM17678-SS | 1086 | 1363 |
| AD14276 | AM20062-AS | 1040 | 1283 | AM17680-SS | 1088 | 1363 |
| AD14277 | AM20063-AS | 1041 | 1324 | AM20068-SS | 1157 | 1404 |
| AD14278 | AM20064-AS | 1042 | 1283 | AM17680-SS | 1088 | 1363 |
| AD14279 | AM20069-AS | 1046 | 1283 | AM17678-SS | 1086 | 1363 |
| AD14280 | AM20070-AS | 1047 | 1324 | AM19044-SS | 1134 | 1404 |
| AD14281 | AM20071-AS | 1048 | 1283 | AM17678-SS | 1086 | 1363 |
| AD14282 | AM20072-AS | 1049 | 1283 | AM17678-SS | 1086 | 1363 |
| AD14283 | AM20073-AS | 1050 | 1324 | AM19044-SS | 1134 | 1404 |
| AD14284 | AM20074-AS | 1051 | 1283 | AM17678-SS | 1086 | 1363 |
| AD14386 | AM20192-AS | 1052 | 1338 | AM20191-SS | 1158 | 1412 |
| AD14387 | AM20194-AS | 1053 | 1339 | AM20193-SS | 1159 | 1411 |
| AD14388 | AM20196-AS | 1054 | 1340 | AM20195-SS | 1160 | 1410 |
| AD14389 | AM20192-AS | 1052 | 1338 | AM20015-SS | 1155 | 1412 |
| AD14390 | AM20197-AS | 1055 | 1338 | AM20191-SS | 1158 | 1412 |
| AD14391 | AM20199-AS | 1056 | 1341 | AM20198-SS | 1161 | 1413 |

TABLE 5A-continued

CFB RNAi Agents Duplexes with Corresponding Sense and Antisense Strand ID Numbers and Sequence ID numbers for the modified and unmodified nucleotide sequences.

| Duplex | AS ID | AS modified SEQ ID NO: | AS unmodified SEQ ID NO: | SS ID | SS modified SEQ ID NO: | SS unmodified SEQ ID NO: |
|---|---|---|---|---|---|---|
| AD14392 | AM20016-AS | 1034 | 1337 | AM20191-SS | 1158 | 1412 |
| AD14393 | AM20200-AS | 1057 | 1338 | AM20015-SS | 1155 | 1412 |
| AD14394 | AM20200-AS | 1057 | 1338 | AM20191-SS | 1158 | 1412 |
| AD14395 | AM20201-AS | 1058 | 1337 | AM20015-SS | 1155 | 1412 |
| AD14396 | AM20202-AS | 1059 | 1337 | AM20015-SS | 1155 | 1412 |
| AD14397 | AM20203-AS | 1060 | 1328 | AM17678-SS | 1086 | 1363 |
| AD14398 | AM20204-AS | 1061 | 1283 | AM19544-SS | 1147 | 1408 |
| AD14399 | AM20206-AS | 1062 | 1342 | AM20205-SS | 1162 | 1414 |
| AD14400 | AM20208-AS | 1063 | 1343 | AM20207-SS | 1163 | 1415 |
| AD14515 | AM19670-AS | 1013 | 1332 | AM20330-SS | 1164 | 1416 |
| AD14516 | AM19671-AS | 1014 | 1333 | AM20331-SS | 1165 | 1417 |
| AD14517 | AM20332-AS | 1064 | 1424 | AM19110-SS | 1136 | 1406 |
| AD14518 | AM20333-AS | 1065 | 1425 | AM19110-SS | 1136 | 1406 |
| AD14570 | AM19111-AS | 994 | 1326 | AM17130-SS | 1077 | 1355 |
| AD14571 | AM20425-AS | 1066 | 1344 | AM17130-SS | 1077 | 1355 |
| AD14637 | AM20494-AS | 1067 | 1345 | AM20493-SS | 1166 | 1418 |
| AD14638 | AM20496-AS | 1068 | 1346 | AM20495-SS | 1167 | 1419 |
| AC003560 | CA004415 | 1430 | 1437 | CS004414 | 1433 | 1438 |
| AC005224 | CA915944 | 1431 | 1341 | CS006373 | 1434 | 1413 |

TABLE 5B

CFB RNAi Agents Duplexes with Corresponding Sense and Antisense Strand ID Numbers Referencing Position Targeted on CFB Gene (SEQ ID NO:1)

| Duplex ID | Antisense Strand ID | Sense Strand ID | Targeted CFB Gene Position (Of SEQ ID NO: 1) |
|---|---|---|---|
| AD12080 | AM17115-AS | AM17114-SS | 936 |
| AD12081 | AM17117-AS | AM17116-SS | 937 |
| AD12082 | AM17119-AS | AM17118-SS | 938 |
| AD12083 | AM17121-AS | AM17120-SS | 939 |
| AD12084 | AM17123-AS | AM17122-SS | 941 |
| AD12085 | AM17125-AS | AM17124-SS | 945 |
| AD12086 | AM17127-AS | AM17126-SS | 949 |
| AD12087 | AM17129-AS | AM17128-SS | 1547 |
| AD12088 | AM17131-AS | AM17130-SS | 1667 |
| AD12089 | AM17133-AS | AM17132-SS | 2255 |
| AD12090 | AM17135-AS | AM17134-SS | 2273 |
| AD12091 | AM17137-AS | AM17136-SS | 2275 |
| AD12092 | AM17139-AS | AM17138-SS | 2279 |
| AD12093 | AM17141-AS | AM17140-SS | 2281 |
| AD12094 | AM17143-AS | AM17142-SS | 2394 |
| AD12095 | AM17145-AS | AM17144-SS | 2395 |
| AD12096 | AM17147-AS | AM17146-SS | 2399 |
| AD12495 | AM17667-AS | AM17146-SS | 2399 |
| AD12496 | AM17668-AS | AM17146-SS | 2399 |
| AD12497 | AM17669-AS | AM17146-SS | 2399 |
| AD12498 | AM17670-AS | AM17146-SS | 2399 |
| AD12499 | AM17671-AS | AM17146-SS | 2399 |
| AD12500 | AM17672-AS | AM17146-SS | 2399 |
| AD12501 | AM17673-AS | AM17146-SS | 2399 |
| AD12502 | AM17674-AS | AM17146-SS | 2399 |
| AD12503 | AM17675-AS | AM17146-SS | 2399 |
| AD12504 | AM17676-AS | AM17146-SS | 2399 |
| AD12505 | AM17677-AS | AM17146-SS | 2399 |
| AD12506 | AM17667-AS | AM17678-SS | 2399 |
| AD12507 | AM17667-AS | AM17679-SS | 2399 |
| AD12508 | AM17667-AS | AM17680-SS | 2399 |
| AD12509 | AM17681-AS | AM17146-SS | 2399 |
| AD12510 | AM17683-AS | AM17682-SS | 515 |
| AD12511 | AM17685-AS | AM17684-SS | 992 |
| AD12512 | AM17687-AS | AM17686-SS | 994 |
| AD12513 | AM17689-AS | AM17688-SS | 1020 |
| AD12514 | AM17691-AS | AM17690-SS | 1290 |
| AD12515 | AM17693-AS | AM17692-SS | 1318 |
| AD12516 | AM17695-AS | AM17694-SS | 1429 |
| AD12517 | AM17697-AS | AM17696-SS | 1586 |
| AD12518 | AM17699-AS | AM17698-SS | 1588 |
| AD12519 | AM17701-AS | AM17700-SS | 1608 |
| AD12520 | AM17703-AS | AM17702-SS | 1851 |
| AD12521 | AM17705-AS | AM17704-SS | 1852 |
| AD12522 | AM17707-AS | AM17706-SS | 305 |
| AD12523 | AM17709-AS | AM17708-SS | 493 |
| AD12524 | AM17711-AS | AM17710-SS | 495 |
| AD12525 | AM17713-AS | AM17712-SS | 778 |
| AD12526 | AM17715-AS | AM17714-SS | 781 |
| AD12527 | AM17717-AS | AM17716-SS | 784 |
| AD12528 | AM17719-AS | AM17718-SS | 845 |
| AD12529 | AM17721-AS | AM17720-SS | 927 |
| AD12530 | AM17723-AS | AM17722-SS | 934 |
| AD12531 | AM17725-AS | AM17724-SS | 954 |
| AD12532 | AM17727-AS | AM17726-SS | 990 |
| AD12533 | AM17729-AS | AM17728-SS | 1019 |
| AD12534 | AM17731-AS | AM17730-SS | 1030 |
| AD12535 | AM17733-AS | AM17732-SS | 1206 |
| AD12536 | AM17735-AS | AM17734-SS | 1315 |
| AD12537 | AM17737-AS | AM17736-SS | 1316 |
| AD12538 | AM17739-AS | AM17738-SS | 1324 |
| AD12539 | AM17741-AS | AM17740-SS | 1384 |
| AD12540 | AM17743-AS | AM17742-SS | 1391 |
| AD12541 | AM17745-AS | AM17744-SS | 1393 |
| AD12542 | AM17747-AS | AM17746-SS | 1432 |
| AD12543 | AM17749-AS | AM17748-SS | 1436 |
| AD12544 | AM17751-AS | AM17750-SS | 1438 |
| AD12545 | AM17753-AS | AM17752-SS | 1459 |
| AD12546 | AM17755-AS | AM17754-SS | 1462 |
| AD12547 | AM17757-AS | AM17756-SS | 1672 |
| AD12548 | AM17759-AS | AM17758-SS | 1673 |
| AD12549 | AM17761-AS | AM17760-SS | 1690 |
| AD12550 | AM17762-AS | AM17130-SS | 1667 |
| AD12551 | AM17763-AS | AM17130-SS | 1667 |
| AD12552 | AM17764-AS | AM17130-SS | 1667 |
| AD12553 | AM17765-AS | AM17130-SS | 1667 |

TABLE 5B-continued

CFB RNAi Agents Duplexes with Corresponding
Sense and Antisense Strand ID Numbers Referencing
Position Targeted on CFB Gene (SEQ ID NO:1)

| Duplex ID | Antisense Strand ID | Sense Strand ID | Targeted CFB Gene Position (Of SEQ ID NO: 1) |
|---|---|---|---|
| AD12554 | AM17766-AS | AM17130-SS | 1667 |
| AD12555 | AM17767-AS | AM17130-SS | 1667 |
| AD12556 | AM17768-AS | AM17130-SS | 1667 |
| AD12557 | AM17769-AS | AM17130-SS | 1667 |
| AD12558 | AM17770-AS | AM17130-SS | 1667 |
| AD12559 | AM17771-AS | AM17130-SS | 1667 |
| AD12560 | AM17772-AS | AM17130-SS | 1667 |
| AD12561 | AM17762-AS | AM17773-SS | 1667 |
| AD12562 | AM17762-AS | AM17774-SS | 1667 |
| AD12563 | AM17762-AS | AM17775-SS | 1667 |
| AD12564 | AM17776-AS | AM17130-SS | 1667 |
| AD12964 | AM17668-AS | AM17678-SS | 2399 |
| AD12965 | AM17674-AS | AM17678-SS | 2399 |
| AD12966 | AM17668-AS | AM17680-SS | 2399 |
| AD12967 | AM17674-AS | AM17680-SS | 2399 |
| AD12968 | AM18396-AS | AM17678-SS | 2399 |
| AD12969 | AM18397-AS | AM17678-SS | 2399 |
| AD12970 | AM18396-AS | AM17680-SS | 2399 |
| AD12971 | AM18397-AS | AM17680-SS | 2399 |
| AD13036 | AM17765-AS | AM17775-SS | 1667 |
| AD13037 | AM17770-AS | AM17775-SS | 1667 |
| AD13038 | AM18482-AS | AM17775-SS | 1667 |
| AD13039 | AM18483-AS | AM17775-SS | 1667 |
| AD13040 | AM18484-AS | AM17775-SS | 1667 |
| AD13041 | AM18485-AS | AM17775-SS | 1667 |
| AD13123 | AM17764-AS | AM17775-SS | 1667 |
| AD13124 | AM17771-AS | AM17775-SS | 1667 |
| AD13125 | AM18618-AS | AM17775-SS | 1667 |
| AD13126 | AM18618-AS | AM17130-SS | 1667 |
| AD13127 | AM18619-AS | AM17130-SS | 1667 |
| AD13128 | AM18619-AS | AM17775-SS | 1667 |
| AD13382 | AM19035-AS | AM17678-SS | 2399 |
| AD13383 | AM19036-AS | AM17678-SS | 2399 |
| AD13384 | AM19037-AS | AM17678-SS | 2399 |
| AD13385 | AM19038-AS | AM17678-SS | 2399 |
| AD13386 | AM19039-AS | AM17678-SS | 2399 |
| AD13387 | AM19040-AS | AM17678-SS | 2399 |
| AD13388 | AM19041-AS | AM17678-SS | 2399 |
| AD13389 | AM19039-AS | AM19042-SS | 2399 |
| AD13390 | AM19039-AS | AM19043-SS | 2399 |
| AD13391 | AM19045-AS | AM19044-SS | 2399 |
| AD13392 | AM19047-AS | AM19046-SS | 2399 |
| AD13435 | AM18484-AS | AM17130-SS | 1667 |
| AD13436 | AM19111-AS | AM19110-SS | 1667 |
| AD13437 | AM19112-AS | AM17130-SS | 1667 |
| AD13438 | AM19113-AS | AM17130-SS | 1667 |
| AD13439 | AM19114-AS | AM17130-SS | 1667 |
| AD13440 | AM19115-AS | AM17130-SS | 1667 |
| AD13441 | AM19116-AS | AM17130-SS | 1667 |
| AD13442 | AM18618-AS | AM19117-SS | 1667 |
| AD13443 | AM19118-AS | AM17130-SS | 1667 |
| AD13534 | AM19217-AS | AM19216-SS | 2398 |
| AD13585 | AM19273-AS | AM17678-SS | 2399 |
| AD13586 | AM19274-AS | AM17130-SS | 1667 |
| AD13616 | AM19316-AS | AM17678-SS | 2399 |
| AD13647 | AM19348-AS | AM17678-SS | 2399 |
| AD13648 | AM19349-AS | AM17678-SS | 2399 |
| AD13649 | AM19350-AS | AM17678-SS | 2399 |
| AD13650 | AM19040-AS | AM19351-SS | 2399 |
| AD13651 | AM19040-AS | AM19352-SS | 2399 |
| AD13652 | AM19040-AS | AM19353-SS | 2399 |
| AD13653 | AM19040-AS | AM19354-SS | 2399 |
| AD13654 | AM19040-AS | AM19355-SS | 2399 |
| AD13655 | AM19040-AS | AM19356-SS | 2399 |
| AD13656 | AM19040-AS | AM19357-SS | 2399 |
| AD13657 | AM19040-AS | AM19358-SS | 2399 |
| AD13816 | AM19543-AS | AM17678-SS | 2399 |
| AD13817 | AM19543-AS | AM19544-SS | 2399 |
| AD13818 | AM17668-AS | AM19544-SS | 2399 |
| AD13819 | AM19543-AS | AM19545-SS | 2399 |
| AD13930 | AM19667-AS | AM19110-SS | 1667 |
| AD13931 | AM19668-AS | AM19110-SS | 1667 |
| AD13932 | AM19669-AS | AM19110-SS | 1667 |
| AD13933 | AM19670-AS | AM19110-SS | 1667 |
| AD13934 | AM19671-AS | AM19110-SS | 1667 |
| AD13935 | AM19111-AS | AM19672-SS | 1667 |
| AD13946 | AM19688-AS | AM17734-SS | 1315 |
| AD13947 | AM19689-AS | AM17734-SS | 1315 |
| AD13948 | AM19690-AS | AM17734-SS | 1315 |
| AD13949 | AM19691-AS | AM17734-SS | 1315 |
| AD13950 | AM19692-AS | AM17734-SS | 1315 |
| AD13951 | AM19693-AS | AM17734-SS | 1315 |
| AD13952 | AM19694-AS | AM17734-SS | 1315 |
| AD13953 | AM19695-AS | AM17734-SS | 1315 |
| AD13954 | AM19696-AS | AM17734-SS | 1315 |
| AD13955 | AM19695-AS | AM19697-SS | 1315 |
| AD13956 | AM19695-AS | AM19698-SS | 1315 |
| AD13957 | AM19695-AS | AM19699-SS | 1315 |
| AD13958 | AM19700-AS | AM17734-SS | 1315 |
| AD14126 | AM19894-AS | AM17678-SS | 2399 |
| AD14127 | AM19895-AS | AM17678-SS | 2399 |
| AD14128 | AM19896-AS | AM17678-SS | 2399 |
| AD14129 | AM19897-AS | AM17678-SS | 2399 |
| AD14130 | AM19898-AS | AM17678-SS | 2399 |
| AD14160 | AM19928-AS | AM17678-SS | 2399 |
| AD14221 | AM20011-AS | AM20010-SS | 1667 |
| AD14222 | AM18618-AS | AM20010-SS | 1667 |
| AD14223 | AM20012-AS | AM20010-SS | 1667 |
| AD14224 | AM20014-AS | AM20013-SS | 1667 |
| AD14225 | AM20016-AS | AM20015-SS | 1667 |
| AD14226 | AM19670-AS | AM19672-SS | 1667 |
| AD14227 | AM19671-AS | AM19672-SS | 1667 |
| AD14230 | AM19671-AS | AM20020-SS | 1667 |
| AD14231 | AM20021-AS | AM19110-SS | 1667 |
| AD14232 | AM20022-AS | AM19110-SS | 1667 |
| AD14233 | AM20023-AS | AM19110-SS | 1667 |
| AD14234 | AM20024-AS | AM19110-SS | 1667 |
| AD14235 | AM20025-AS | AM19110-SS | 1667 |
| AD14270 | AM20062-AS | AM17678-SS | 2399 |
| AD14271 | AM20063-AS | AM19044-SS | 2399 |
| AD14272 | AM20064-AS | AM17678-SS | 2399 |
| AD14273 | AM20065-AS | AM17678-SS | 2399 |
| AD14274 | AM20066-AS | AM19044-SS | 2399 |
| AD14275 | AM20067-AS | AM17678-SS | 2399 |
| AD14276 | AM20062-AS | AM17680-SS | 2399 |
| AD14277 | AM20063-AS | AM20068-SS | 2399 |
| AD14278 | AM20064-AS | AM17680-SS | 2399 |
| AD14279 | AM20069-AS | AM17678-SS | 2399 |
| AD14280 | AM20070-AS | AM19044-SS | 2399 |
| AD14281 | AM20071-AS | AM17678-SS | 2399 |
| AD14282 | AM20072-AS | AM17678-SS | 2399 |
| AD14283 | AM20073-AS | AM19044-SS | 2399 |
| AD14284 | AM20074-AS | AM17678-SS | 2399 |
| AD14386 | AM20192-AS | AM20191-SS | 1667 |
| AD14387 | AM20194-AS | AM20193-SS | 1667 |
| AD14388 | AM20196-AS | AM20195-SS | 1667 |
| AD14389 | AM20192-AS | AM20015-SS | 1667 |
| AD14390 | AM20197-AS | AM20191-SS | 1667 |
| AD14391 | AM20199-AS | AM20198-SS | 1667 |
| AD14392 | AM20016-AS | AM20191-SS | 1667 |
| AD14393 | AM20200-AS | AM20015-SS | 1667 |
| AD14394 | AM20200-AS | AM20191-SS | 1667 |
| AD14395 | AM20201-AS | AM20015-SS | 1667 |
| AD14396 | AM20202-AS | AM20015-SS | 1667 |
| AD14397 | AM20203-AS | AM17678-SS | 2399 |
| AD14398 | AM20204-AS | AM19544-SS | 2399 |
| AD14399 | AM20206-AS | AM20205-SS | 2399 |
| AD14400 | AM20208-AS | AM20207-SS | 2399 |
| AD14515 | AM19670-AS | AM20330-SS | 1667 |
| AD14516 | AM19671-AS | AM20331-SS | 1667 |
| AD14517 | AM20332-AS | AM19110-SS | 1667 |
| AD14518 | AM20333-AS | AM19110-SS | 1667 |

TABLE 5B-continued

CFB RNAi Agents Duplexes with Corresponding Sense and Antisense Strand ID Numbers Referencing Position Targeted on CFB Gene (SEQ ID NO:1)

| Duplex ID | Antisense Strand ID | Sense Strand ID | Targeted CFB Gene Position (Of SEQ ID NO: 1) |
|---|---|---|---|
| AD14570 | AM19111-AS | AM17130-SS | 1667 |
| AD14571 | AM20425-AS | AM17130-SS | 1667 |
| AD14637 | AM20494-AS | AM20493-SS | 1667 |
| AD14638 | AM20496-AS | AM20495-SS | 1667 |
| AC003560 | CA004415 | CS004414 | 1667 |
| AC005224 | CA915944 | CS006373 | 1667 |

TABLE 5C

CFB RNAi Agent Duplexes Showing Chemically Modified Antisense Strand and Sense Strand Sequences

| Duplex ID: | Modified Antisense Strand (5' → 3') | SEQ ID NO. |
|---|---|---|
| AD12080 | usAfsusCfuAfgCfaCfcAfgGfuAfgAfuGfsc | 897 |
| AD12081 | usCfsasUfcUfaGfcAfcCfaGfgUfaGfaUfsg | 898 |
| AD12082 | usCfscsAfuCfuAfgCfaCfcAfgGfuAfgAfsu | 899 |
| AD12083 | asUfscsCfaUfcUfaGfcAfcCfaGfgUfaGfsa | 900 |
| AD12084 | usGfsasUfcCfaUfcUfaGfcAfcCfaGfgUfsa | 901 |
| AD12085 | usGfsusCfuGfaUfcCfaUfcUfaGfcAfcCfsa | 902 |
| AD12086 | asUfsgsCfuGfuCfuGfaUfcCfaUfcUfaGfsc | 903 |
| AD12087 | usAfsusGfcCfaCfaGfaGfaCfuCfaGfaGfsa | 904 |
| AD12088 | asAfsasGfuAfcUfcAfgAfcAfcCfaCfaGfsc | 905 |
| AD12089 | usAfscsAfcCfaAfcUfuGfaAfuGfaAfaCfsg | 906 |
| AD12090 | usAfscsUfaCfuCfcCfcAfgCfuGfaUfuAfsc | 907 |
| AD12091 | usCfscsAfcUfaCfuCfcCfcAfgCfuGfaUfsc | 908 |
| AD12092 | usAfscsAfuCfcAfcUfaCfuCfcCfcAfgCfsu | 909 |
| AD12093 | usAfsgsAfcAfuCfcAfcUfaCfuCfcCfcAfsg | 910 |
| AD12094 | asAfscsCfcAfaAfuCfcAfcUfaCfuUfgGfsa | 911 |
| AD12095 | asAfsasCfcCfaAfaUfcCfcUfaCfuCfuGfsg | 912 |
| AD12096 | usAfsgsAfaAfaCfcCfaAfaUfcCfuCfaUfsc | 913 |
| AD12495 | usAfsgsAfaaacccaAfaUfcCfucausc | 914 |
| AD12496 | usAfsgsaAfaacccaAfaUfcCfucausc | 915 |
| AD12497 | usAfsgsaaaAfcccaAfaUfcCfucausc | 916 |
| AD12498 | usAfsgsaaaacCfcaAfaUfcCfucausc | 917 |
| AD12499 | usAfsgsAfaAfacccaaaUfcCfucausc | 918 |
| AD12500 | usAfsgsaaAfacccaaaUfcCfucausc | 919 |
| AD12501 | usAfsgsaaaacccaaaUfcCfucausc | 920 |
| AD12502 | usAfsgsaaaacccaAfaUfccucausc | 921 |
| AD12503 | usAfsgsaAfaacccaaaUfccucausc | 922 |
| AD12504 | usAfsgAfaaacccaAfaUfcCfucausc | 923 |
| AD12505 | usAfgAfaaacccaAfaUfcCfucaussc | 1429 |
| AD12506 | usAfsgsAfaaacccaAfaUfcCfucausc | 914 |

TABLE 5C-continued

CFB RNAi Agent Duplexes Showing Chemically Modified Antisense
Strand and Sense Strand Sequences

| | | |
|---|---|---|
| AD12507 | usAfsgsAfaaacccaAfaUfcCfucausc | 914 |
| AD12508 | usAfsgsAfaaacccaAfaUfcCfucausc | 914 |
| AD12509 | cPrpusAfsgsAfaaacccaAfaUfcCfucausc | 924 |
| AD12510 | asGfsusGfuAfaCfcGfuCfaUfaGfcAfgUfsg | 925 |
| AD12511 | usUfsusGfaCfuAfgAfcAfcUfuUfuUfgGfsc | 926 |
| AD12512 | asAfsgsUfuGfaCfuAfgAfcAfcUfuUfuUfsg | 927 |
| AD12513 | usAfscsCfaUfaAfcUfuGfcCfaCfcUfuCfsu | 928 |
| AD12514 | usCfsasUfgUfuGfuGfcAfaUfcCfaUfcAfsg | 929 |
| AD12515 | usCfsasUfcAfaUfgAfcAfgUfaAfuUfgGfsg | 930 |
| AD12516 | usCfsasUfuGfaUfgUfuCfaCfuUfgGfuUfsc | 931 |
| AD12517 | usUfsgsCfuUfgUfgGfuAfaUfcGfgUfaCfsc | 932 |
| AD12518 | usGfsusUfgCfuUfgUfgGfuAfaUfcGfgUfsg | 933 |
| AD12519 | usUfsgsAfgAfuCfuUfgGfcCfuGfcCfaUfsg | 934 |
| AD12520 | usCfsusUfgAfuCfaGfgGfcAfaCfgUfcAfsc | 935 |
| AD12521 | asGfscsUfuGfaUfcAfgGfgCfaAfcGfuCfsa | 936 |
| AD12522 | usAfsasGfcCfaGfaAfgGfaCfaCfaCfgUfsa | 937 |
| AD12523 | asAfsasGfaGfaUfcUfcAfuCfaCfuCfaCfsa | 938 |
| AD12524 | usGfsasAfaGfaGfaUfcUfcAfuCfaCfuCfsa | 939 |
| AD12525 | usAfscsAfuGfaAfgGfaGfuCfuUfgGfcAfsg | 940 |
| AD12526 | usCfsgsUfaCfaUfgAfaGfgAfgUfcUfgGfsg | 941 |
| AD12527 | usUfsgsUfcGfuAfcAfuGfaAfgGfaGfuCfsu | 942 |
| AD12528 | asUfscsGfaCfuCfcUfuCfuAfuGfgUfcUfsc | 943 |
| AD12529 | usCfsasGfgUfaGfaUfgUfuCfaUfgGfaGfsc | 944 |
| AD12530 | usCfsusAfgCfaCfcAfgGfuAfgAfuGfuUfsc | 945 |
| AD12531 | usCfscsCfaAfuGfcUfgUfcUfgAfuCfcAfsc | 946 |
| AD12532 | usGfsasCfuAfgAfcAfcUfuUfuUfgGfcUfsc | 947 |
| AD12533 | asCfscsAfuAfaCfuUfgCfcAfcCfuUfcUfsc | 948 |
| AD12534 | usUfsusGfgCfuUfcAfcAfcCfaUfaAfcUfsc | 949 |
| AD12535 | usCfsasUfcAfuGfcUfgUfaCfaCfuGfcCfsu | 950 |
| AD12536 | usCfsasAfuGfaCfaGfuAfaUfgGfgUfcCfsc | 951 |
| AD12537 | asUfscsAfaUfgAfcAfgUfaAfuUfgGfgUfsc | 952 |
| AD12538 | usGfsgsAfuCfuCfaUfcAfaUfgAfcAfgUfsg | 953 |
| AD12539 | usAfsgsAfcAfuCfcAfgAfuAfaUfcCfuCfsc | 954 |
| AD12540 | asAfsasCfaCfaUfaGfaCfaUfcCfaGfaUfsg | 955 |
| AD12541 | usCfsasAfaCfaCfaUfaGfaCfaUfcCfaGfsa | 956 |
| AD12542 | asAfsasGfcAfuUfgAfuGfuUfcAfcUfuGfsg | 957 |
| AD12543 | asGfscsCfaAfaGfcAfuUfgAfuGfuUfcAfsc | 958 |
| AD12544 | usAfsasGfcCfaAfaGfcAfuUfgAfuGfuUfsc | 959 |

TABLE 5C-continued

CFB RNAi Agent Duplexes Showing Chemically Modified Antisense
Strand and Sense Strand Sequences

| | | |
|---|---|---|
| AD12545 | usGfsusUfgCfuCfaUfuGfuCfuUfuCfuUfsg | 960 |
| AD12546 | asCfsasUfgUfuGfcUfcAfuUfgUfcUfuUfsc | 961 |
| AD12547 | asGfscsAfcAfaAfgUfaCfuCfaGfaCfaCfsc | 962 |
| AD12548 | usAfsgsCfaCfaAfaGfuAfcUfcAfgAfcAfsc | 963 |
| AD12549 | asAfsasCfaAfuGfuGfcUfgCfuGfuCfaGfsc | 964 |
| AD12550 | asAfsasGfuacucagAfcAfcCfacagsc | 965 |
| AD12551 | asAfsasgUfacucagAfcAfcCfacagsc | 966 |
| AD12552 | asAfsasguaCfucagAfcAfcCfacagsc | 967 |
| AD12553 | asAfsasguacuCfagAfcAfcCfacagsc | 968 |
| AD12554 | asAfsasGfuAfcucagacAfcCfacagsc | 969 |
| AD12555 | asAfsasguAfcucagacAfcCfacagsc | 970 |
| AD12556 | asAfsasguacucagAfcAfccacagsc | 971 |
| AD12557 | asAfsasguacucagacAfcCfacagsc | 972 |
| AD12558 | asAfsasgUfacucagacAfccacagsc | 973 |
| AD12559 | asAfsaGfuacucagAfcAfcCfacagsc | 974 |
| AD12560 | asAfaGfuacucagAfcAfcCfacagssc | 975 |
| AD12561 | asAfsasGfuacucagAfcAfcCfacagsc | 965 |
| AD12562 | asAfsasGfuacucagAfcAfcCfacagsc | 965 |
| AD12563 | asAfsasGfuacucagAfcAfcCfacagsc | 965 |
| AD12564 | cPrpasAfsasGfuacucagAfcAfcCfacagsc | 976 |
| AD12964 | usAfsgsaAfaacccaAfaUfcCfucausc | 915 |
| AD12965 | usAfsgsaaaacccaAfaUfccucausc | 921 |
| AD12966 | usAfsgsaAfaacccaAfaUfcCfucausc | 915 |
| AD12967 | usAfsgsaaaacccaAfaUfccucausc | 921 |
| AD12968 | usAfgaAfaacccaAfaUfcCfucaussc | 977 |
| AD12969 | usAfgaaaacccaAfaUfccucaussc | 978 |
| AD12970 | usAfgaAfaacccaAfaUfcCfucaussc | 977 |
| AD12971 | usAfgaaaacccaAfaUfccucaussc | 978 |
| AD13036 | asAfsasguacuCfagAfcAfcCfacagsc | 968 |
| AD13037 | asAfsasgUfacucagacAfccacagsc | 973 |
| AD13038 | asAfsaguacuCfagAfcAfcCfacagsc | 979 |
| AD13039 | asAfsagUfacucagacAfccacagsc | 980 |
| AD13040 | dAssAfsaguacuCfagAfcAfcCfacagsc | 981 |
| AD13041 | dAssAfsagUfacucagacAfccacagsc | 982 |
| AD13123 | asAfsasguaCfucagAfcAfcCfacagsc | 967 |
| AD13124 | asAfsaGfuacucagAfcAfcCfacagsc | 974 |
| AD13125 | asAfsaguaCfucagAfcAfcCfacagsc | 983 |
| AD13126 | asAfsaguaCfucagAfcAfcCfacagsc | 983 |
| AD13127 | dAssAfaguaCfucagAfcAfcCfacagsc | 984 |

TABLE 5C-continued

CFB RNAi Agent Duplexes Showing Chemically Modified Antisense
Strand and Sense Strand Sequences

| | | |
|---|---|---|
| AD13128 | dAssAfaguaCfucagAfcAfcCfacagsc | 984 |
| AD13382 | dTssAfgaAfaacccaAfaUfcCfucausc | 985 |
| AD13383 | usAfsgsadAaacccaAfaUfcCfucausc | 986 |
| AD13384 | usAfsgsadAaacccadAaUfcCfucausc | 987 |
| AD13385 | usAfsgsadAaacccadAaUfcdCucausc | 988 |
| AD13386 | usdAsgsadAaacccadAaUfcdCucausc | 989 |
| AD13387 | usdAsgsadAaacccadAadTcdCucausc | 990 |
| AD13388 | dTssdAgadAaacccadAaUfcdCucausc | 991 |
| AD13389 | usdAsgsadAaacccadAaUfcdCucausc | 989 |
| AD13390 | usdAsgsadAaacccadAaUfcdCucausc | 989 |
| AD13391 | usAfsgsaAfaacccaAfaUfcCfucacsc | 992 |
| AD13392 | usAfsgsaAfaacccaAfaUfcCfucagsc | 993 |
| AD13435 | dAssAfsaguacuCfagAfcAfcCfacagsc | 981 |
| AD13436 | usAfsaguaCfucagAfcAfcCfacagsc | 994 |
| AD13437 | asAfsaguadCucagAfcAfcCfacagsc | 995 |
| AD13438 | asAfsaguadCucagdAcAfcdCacagsc | 996 |
| AD13439 | asdAsaguadCucagdAcAfcdCacagsc | 997 |
| AD13440 | asdAsaguadCucagdAcdAcdCacagsc | 998 |
| AD13441 | asdAsaguaCfucagAfcdAcCfacagsc | 999 |
| AD13442 | asAfsaguaCfucagAfcAfcCfacagsc | 983 |
| AD13443 | asAfsaguaCUNAucagAfcAfcCfacagsc | 1000 |
| AD13534 | asGfsasAfaAfcCfcAfaAfuCfcUfcAfuCfsu | 1001 |
| AD13585 | cPrpusAfsgsaAfaacccaAfaUfcCfucausc | 1002 |
| AD13586 | cPrpasAfsaguaCfucagAfcAfcCfacagsc | 1003 |
| AD13616 | dTssAfsgsaAfaacccaAfaUfcCfucausc | 1004 |
| AD13647 | usdAsgsadAadAcccadAaUfccucausc | 1005 |
| AD13648 | usdAsgsadAaacdCcadAaUfccucausc | 1006 |
| AD13649 | usdAsgsaaadAcdCcadAaUfccucausc | 1007 |
| AD13650 | usdAsgsadAaacccadAadTcdCucausc | 1008 |
| AD13651 | usdAsgsadAaacccadAadTcdCucausc | 1008 |
| AD13652 | usdAsgsadAaacccadAadTcdCucausc | 1008 |
| AD13653 | usdAsgsadAaacccadAadTcdCucausc | 1008 |
| AD13654 | usdAsgsadAaacccadAadTcdCucausc | 1008 |
| AD13655 | usdAsgsadAaacccadAadTcdCucausc | 1008 |
| AD13656 | usdAsgsadAaacccadAadTcdCucausc | 1008 |
| AD13657 | usdAsgsadAaacccadAadTcdCucausc | 1008 |
| AD13816 | usAfsgsaAfaacccaAfaUfcCfucsa | 1009 |
| AD13817 | usAfsgsaAfaacccaAfaUfcCfucsa | 1009 |

TABLE 5C-continued

CFB RNAi Agent Duplexes Showing Chemically Modified Antisense
Strand and Sense Strand Sequences

| | | |
|---|---|---|
| AD13818 | usAfsgsaAfaacccaAfaUfcCfucausc | 915 |
| AD13819 | usAfsgsaAfaacccaAfaUfcCfucsa | 1009 |
| AD13930 | usAfsaguaCfuuagAfcAfcCfacagsc | 1010 |
| AD13931 | usAfsaguaCfucagAfuAfcCfacagsc | 1011 |
| AD13932 | usAfsaguaCfucagAfcAfuCfacagsc | 1012 |
| AD13933 | usAfsaguaCfucagAfcAfcUfacagsc | 1013 |
| AD13934 | usAfsaguaCfucagAfcAfcCfauagsc | 1014 |
| AD13935 | usAfsaguaCfucagAfcAfcCfacagsc | 994 |
| AD13946 | usCfsasaUfgacaguAfaUfuGfggucsc | 1015 |
| AD13947 | usCfsasaugAfcaguAfaUfuGfggucsc | 1016 |
| AD13948 | usCfsasaugacAfguAfaUfuGfggucsc | 1017 |
| AD13949 | usCfsasaugaCfaguaaUfuggguCfsc | 1018 |
| AD13950 | usCfsasaugAfcaguaaUfugggucsc | 1019 |
| AD13951 | usCfsasaugacAfguaaUfugggucsc | 1020 |
| AD13952 | usCfsasaUfgAUNAcaguAfaUfuGfggucsc | 1021 |
| AD13953 | usCfsaaugAfcaguAfaUfuGfggucsc | 1022 |
| AD13954 | usCfsaaugAfcaguAfaUfuGfggucssc | 1023 |
| AD13955 | usCfsaaugAfcaguAfaUfuGfggucsc | 1022 |
| AD13956 | usCfsaaugAfcaguAfaUfuGfggucsc | 1022 |
| AD13957 | usCfsaaugAfcaguAfaUfuGfggucsc | 1022 |
| AD13958 | dTssCfsasaugAfcaguAfaUfuGfggucsc | 1024 |
| AD14126 | dTssAfsgaAfaacccaAfaUfcCfucausc | 1025 |
| AD14127 | dTssAfsgaAfaacccaAfaUfcCfucaussc | 1026 |
| AD14128 | UfssAfsgaAfaacccaAfaUfcCfucausc | 1027 |
| AD14129 | UfssAfsgaAfaacccaAfaUfcCfucaussc | 1028 |
| AD14130 | UfssAfgaAfaacccaAfaUfcCfucaussc | 1029 |
| AD14160 | isAfsgsaAfaacccaAfaUfcCfucausc | 1030 |
| AD14221 | asAfsaguaCfucagAfcAfcCfacsa | 1031 |
| AD14222 | asAfsaguaCfucagAfcAfcCfacagsc | 983 |
| AD14223 | asAfsaguaCfucagAfcAfcCfacasgsc | 1032 |
| AD14224 | asAfsaguaCfucagAfcAfcCfacgsgsc | 1033 |
| AD14225 | asAfsaguaCfucagAfcAfcCfaccsgsc | 1034 |
| AD14226 | usAfsaguaCfucagAfcAfcUfacagsc | 1013 |
| AD14227 | usAfsaguaCfucagAfcAfcCfauagsc | 1014 |
| AD14230 | usAfsaguaCfucagAfcAfcCfauagsc | 1014 |
| AD14231 | usAfsaguaCfucagAfcAfcCfauagssc | 1035 |
| AD14232 | ussAfsaguaCfucagAfcAfcCfauagsc | 1036 |
| AD14233 | ussAfsaguaCfucagAfcAfcCfauagssc | 1037 |
| AD14234 | dTssAfsaguaCfucagAfcAfcCfauagssc | 1038 |

TABLE 5C-continued

CFB RNAi Agent Duplexes Showing Chemically Modified Antisense
Strand and Sense Strand Sequences

| | | |
|---|---|---|
| AD14235 | cPrpusAfsaguaCfucagAfcAfcCfauagsc | 1039 |
| AD14270 | usAfsgaAfaacccaAfaUfcCfucausc | 1040 |
| AD14271 | usAfsgaAfaacccaAfaUfcCfucacsc | 1041 |
| AD14272 | usAfsgadAaacccaAfaUfcCfucausc | 1042 |
| AD14273 | usAfsgaaaAfcccaAfaUfcCfucausc | 1043 |
| AD14274 | usAfsgaaaAfcccaAfaUfcCfucacsc | 1044 |
| AD14275 | usAfsgaaadAcccaAfaUfcCfucausc | 1045 |
| AD14276 | usAfsgaAfaacccaAfaUfcCfucausc | 1040 |
| AD14277 | usAfsgaAfaacccaAfaUfcCfucacsc | 1041 |
| AD14278 | usAfsgadAaacccaAfaUfcCfucausc | 1042 |
| AD14279 | ussAfsgaAfaacccaAfaUfcCfucausc | 1046 |
| AD14280 | ussAfsgaAfaacccaAfaUfcCfucacsc | 1047 |
| AD14281 | ussAfsgadAaacccaAfaUfcCfucausc | 1048 |
| AD14282 | ussAfsgaAfaacccaAfaUfcCfucaussc | 1049 |
| AD14283 | ussAfsgaAfaacccaAfaUfcCfucacssc | 1050 |
| AD14284 | ussAfsgadAaacccaAfaUfcCfucaussc | 1051 |
| AD14386 | asAfsaguaCfucagAfcAfcCfacsc | 1052 |
| AD14387 | asAfsaguaCfucagAfcAfcCfacsg | 1053 |
| AD14388 | asAfsaguaCfucagAfcAfcCfacsa_2N | 1054 |
| AD14389 | asAfsaguaCfucagAfcAfcCfacsc | 1052 |
| AD14390 | cPrpasAfsaguaCfucagAfcAfcCfacsc | 1055 |
| AD14391 | usAfsaguaCfucagAfcAfcCfacsc | 1056 |
| AD14392 | asAfsaguaCfucagAfcAfcCfaccsgsc | 1034 |
| AD14393 | asAfsaguaCfucagAfcAfcCfascsc | 1057 |
| AD14394 | asAfsaguaCfucagAfcAfcCfascsc | 1057 |
| AD14395 | asAfsaguaCfucagAfcAfcCfaccsgssc | 1058 |
| AD14396 | asAfsaguaCfucagAfcAfcCfaccgssc | 1059 |
| AD14397 | usAfsgaAfaacccaAfaUfcCfuscsa | 1060 |
| AD14398 | usAfsgaAfaacccaAfaUfcCfucasusc | 1061 |
| AD14399 | usAfsgaAfaacccaAfaUfcCfuccsusc | 1062 |
| AD14400 | usAfsgaAfaacccaAfaUfcCfucgsusc | 1063 |
| AD14515 | usAfsaguaCfucagAfcAfcUfacagsc | 1013 |
| AD14516 | usAfsaguaCfucagAfcAfcCfauagsc | 1014 |
| AD14517 | usAfsaguaCfucagAfcAfcdTacagsc | 1064 |
| AD14518 | usAfsaguaCfucagAfcAfcCfadTagsc | 1065 |
| AD14570 | usAfsaguaCfucagAfcAfcCfacagsc | 994 |
| AD14571 | isAfsaguaCfucagAfcAfcCfacagsc | 1066 |
| AD14637 | usAfsaguaCfucacAfcAfcUfacagsc | 1067 |

TABLE 5C-continued

CFB RNAi Agent Duplexes Showing Chemically Modified Antisense
Strand and Sense Strand Sequences

| | | |
|---|---|---|
| AD14638 | usAfsagucCfucacAfcAfcAfacagsc | 1068 |
| AC003560 | asAfsaguaCfucagAfcAfcCfacagsu | 1430 |
| AC005224 | usAfsaguaCfucagAfcAfcCfacsc | 1431 |

| Duplex ID: | Modified Sense Strand (5' → 3') | SEQ ID NO. |
|---|---|---|
| AD12080 | (NAG37)s(invAb)sgcaucuacCfUfGfgugcuagauas(invAb) | 1069 |
| AD12081 | (NAG37)s(invAb)scaucuaccUfGfGfugcuagaugas(invAb) | 1070 |
| AD12082 | (NAG37)s(invAb)saucuaccuGfGfUfgcuagauigas(invAb) | 1071 |
| AD12083 | (NAG37)s(invAb)sucuaccugGfUfGfcuagauigaus(invAb) | 1072 |
| AD12084 | (NAG37)s(invAb)suaccugguGfCfUfagaugiaucas(invAb) | 1073 |
| AD12085 | (NAG37)s(invAb)suggugcuaGfAfUfggaucaiacas(invAb) | 1074 |
| AD12086 | (NAG37)s(invAb)sgcuagaugGfAfUfcagacaicaus(invAb) | 1075 |
| AD12087 | (NAG37)s(invAb)sucucugagUfCfUfcugugicauas(invAb) | 1076 |
| AD12088 | (NAG37)s(invAb)sgcugugguGfUfCfugaguacuuus(invAb) | 1077 |
| AD12089 | (NAG37)s(invAb)scguuucauUfCfAfaguugiuguas(invAb) | 1078 |
| AD12090 | (NAG37)s(invAb)sgua_2NaucagCfUfGfgggaguaguas(invAb) | 1079 |
| AD12091 | (NAG37)s(invAb)sgaucagcuGfGfGfgaguaguigas(invAb) | 1080 |
| AD12092 | (NAG37)s(invAb)sagcuggggAfGfUfagugiaugas(invAb) | 1081 |
| AD12093 | (NAG37)s(invAb)scuggggagUfAfGfuggaugucuas(invAb) | 1083 |
| AD12094 | (NAG37)s(invAb)succaagauGfAfGfgauuugiguus(invAb) | 1083 |
| AD12095 | (NAG37)s(invAb)sccaagaugAfGfGfauuugiguuus(invAb) | 1084 |
| AD12096 | (NAG37)s(invAb)sgaugaggaUfUfUfgggbuuucuas(invAb) | 1085 |
| AD12495 | (NAG37)s(invAb)sgaugaggaUfUfUfgggbuuucuas(invAb) | 1085 |
| AD12496 | (NAG37)s(invAb)sgaugaggaUfUfUfgggbuuucuas(invAb) | 1085 |
| AD12497 | (NAG37)s(invAb)sgaugaggaUfUfUfgggbuuucuas(invAb) | 1085 |
| AD12498 | (NAG37)s(invAb)sgaugaggaUfUfUfgggbuuucuas(invAb) | 1085 |
| AD12499 | (NAG37)s(invAb)sgaugaggaUfUfUfgggbuuucuas(invAb) | 1085 |
| AD12500 | (NAG37)s(invAb)sgaugaggaUfUfUfgggbuuucuas(invAb) | 1085 |
| AD12501 | (NAG37)s(invAb)sgaugaggaUfUfUfgggbuuucuas(invAb) | 1085 |
| AD12502 | (NAG37)s(invAb)sgaugaggaUfUfUfgggbuuucuas(invAb) | 1085 |
| AD12503 | (NAG37)s(invAb)sgaugaggaUfUfUfgggbuuucuas(invAb) | 1085 |
| AD12504 | (NAG37)s(invAb)sgaugaggaUfUfUfgggbuuucuas(invAb) | 1085 |
| AD12505 | (NAG37)s(invAb)sgaugaggaUfUfUfgggbuuucuas(invAb) | 1085 |
| AD12506 | (NAG37)s(invAb)sgaugaggaUfuUfGfgggbuuucuas(invAb) | 1086 |
| AD12507 | (NAG37)s(invAb)sgaugaggaUfuUfgGfgguuucuas(invAb) | 1087 |
| AD12508 | (NAG37)s(invAb)sgaugagGfaUfuUfgggbuuucuas(invAb) | 1088 |
| AD12509 | (NAG37)s(invAb)sgaugaggaUfUfUfgggbuuucuas(invAb) | 1085 |
| AD12510 | (NAG37)s(invAb)scacugcuaUfGfAfcgguuacacus(invAb) | 1089 |
| AD12511 | (NAG37)s(invAb)sgccaaaaaGfUfGfucuagucaaas(invAb) | 1090 |

TABLE 5C-continued

CFB RNAi Agent Duplexes Showing Chemically Modified Antisense
Strand and Sense Strand Sequences

| | | |
|---|---|---|
| AD12512 | (NAG37)s(invAb)sca_2NaaaaguGfUfCfuagucaacuus(invAb) | 1091 |
| AD12513 | (NAG37)s(invAb)sagaagguGfCfAfaguuaugguas(invAb) | 1092 |
| AD12514 | (NAG37)s(invAb)scugauggaUfUfGfcacaacaugas(invAb) | 1093 |
| AD12515 | (NAG37)s(invAb)scccaauuaCfUfGfucauugaugas(invAb) | 1094 |
| AD12516 | (NAG37)s(invAb)sgaaccaagUfGfAfacaucaaugas(invAb) | 1095 |
| AD12517 | (NAG37)s(invAb)sgguaccgaUfUfAfccacaaicaas(invAb) | 1096 |
| AD12518 | (NAG37)s(invAb)scaccgauuAfCfCfacaaicaacas(invAb) | 1097 |
| AD12519 | (NAG37)s(invAb)scauggcagGfCfCfaagaucucaas(invAb) | 1098 |
| AD12520 | (NAG37)s(invAb)sgugacguuGfCfCfcugaucaagas(invAb) | 1099 |
| AD12521 | (NAG37)s(invAb)sugacguugCfCfCfugaucaaicus(invAb) | 1100 |
| AD12522 | (NAG37)s(invAb)suacgugugUfCfCfuucugicuuas(invAb) | 1101 |
| AD12523 | (NAG37)s(invAb)sugugagugAfUfGfagaucucuuus(invAb) | 1102 |
| AD12524 | (NAG37)s(invAb)sugagugauGfAfGfaucucuuucas(invAb) | 1103 |
| AD12525 | (NAG37)s(invAb)scugccaagAfCfUfccuucauguas(invAb) | 1104 |
| AD12526 | (NAG37)s(invAb)sccaagacuCfCfUfucauguacias(invAb) | 1105 |
| AD12527 | (NAG37)s(invAb)sagacuccuUfCfAfuguaciacaas(invAb) | 1106 |
| AD12528 | (NAG37)s(invAb)sgagaccauAfGfAfaggaiucgaus(invAb) | 1107 |
| AD12529 | (NAG37)s(invAb)sgcuccaugAfAfCfaucuaccuias(invAb) | 1108 |
| AD12530 | (NAG37)s(invAb)sgaacaucuAfCfCfugguicuagas(invAb) | 1109 |
| AD12531 | (NAG37)s(invAb)sguggaucaGfAfCfagcauugigas(invAb) | 1110 |
| AD12532 | (NAG37)s(invAb)sgagccaaaAfAfGfugucuaiucas(invAb) | 1111 |
| AD12533 | (NAG37)s(invAb)sgagaagguGfGfCfaaguuauggus(invAb) | 1112 |
| AD12534 | (NAG37)s(invAb)sgaguuaugGfUfGfugaaiccaaas(invAb) | 1113 |
| AD12535 | (NAG37)s(invAb)saggcagugUfAfCfagcaugaugas(invAb) | 1114 |
| AD12536 | (NAG37)s(invAb)sggacccaaUfUfAfcugucauugas(invAb) | 1115 |
| AD12537 | (NAG37)s(invAb)sgacccaauUfAfCfugucauugaus(invAb) | 1116 |
| AD12538 | (NAG37)s(invAb)scacugucaUfUfGfaugaiauccas(invAb) | 1117 |
| AD12539 | (NAG37)s(invAb)sggaggauuAfUfCfugggaugucuas(invAb) | 1118 |
| AD12540 | (NAG37)s(invAb)scaucuggaUfGfUfcuauguguuus(invAb) | 1119 |
| AD12541 | (NAG37)s(invAb)sucuggaugUfCfUfauguguuugas(invAb) | 1120 |
| AD12542 | (NAG37)s(invAb)sccaagugaAfCfAfucaaugcuuus(invAb) | 1121 |
| AD12543 | (NAG37)s(invAb)sgugaacauCfAfAfugcuuugicus(invAb) | 1122 |
| AD12544 | (NAG37)s(invAb)sgaacaucaAfUfGfcuuugicuuas(invAb) | 1123 |
| AD12545 | (NAG37)s(invAb)scaagaaagAfCfAfaugaicaacas(invAb) | 1124 |
| AD12546 | (NAG37)s(invAb)sga_2NaagacaAfUfGfagcaacaugus(invAb) | 1125 |
| AD12547 | (NAG37)s(invAb)sggugucugAfGfUfacuuuguicus(invAb) | 1126 |
| AD12548 | (NAG37)s(invAb)sgugucugaUfAfcuuuguicuas(invAb) | 1127 |
| AD12549 | (NAG37)s(invAb)sgcugacagCfAfGfcacauuguuus(invAb) | 1128 |
| AD12550 | (NAG37)s(invAb)sgcuguggUfUfCfugaguacuuus(invAb) | 1077 |

TABLE 5C-continued

CFB RNAi Agent Duplexes Showing Chemically Modified Antisense
Strand and Sense Strand Sequences

| | | |
|---|---|---|
| AD12551 | (NAG37)s(invAb)sgcuguggGuGfUfCfugaguacuuus(invAb) | 1077 |
| AD12552 | (NAG37)s(invAb)sgcugugguGfUfCfugaguacuuus(invAb) | 1077 |
| AD12553 | (NAG37)s(invAb)sgcugugguGfUfCfugaguacuuus(invAb) | 1077 |
| AD12554 | (NAG37)s(invAb)sgcugugguGfUfCfugaguacuuus(invAb) | 1077 |
| AD12555 | (NAG37)s(invAb)sgcugugguGfUfCfugaguacuuus(invAb) | 1077 |
| AD12556 | (NAG37)s(invAb)sgcugugguGfUfCfugaguacuuus(invAb) | 1077 |
| AD12557 | (NAG37)s(invAb)sgcugugguGfUfCfugaguacuuus(invAb) | 1077 |
| AD12558 | (NAG37)s(invAb)sgcugugguGfUfCfugaguacuuus(invAb) | 1077 |
| AD12559 | (NAG37)s(invAb)sgcugugguGfUfCfugaguacuuus(invAb) | 1077 |
| AD12560 | (NAG37)s(invAb)sgcugugguGfUfCfugaguacuuus(invAb) | 1077 |
| AD12561 | (NAG37)s(invAb)sgcuguggGfuCfUfugaguacuuus(invAb) | 1129 |
| AD12562 | (NAG37)s(invAb)sgcuguggGfuCfuGfaguacuuus(invAb) | 1130 |
| AD12563 | (NAG37)s(invAb)sgcugugGfuGfuCfugaguacuuus(invAb) | 1131 |
| AD12564 | (NAG37)s(invAb)sgcugugguGfUfCfugaguacuuus(invAb) | 1077 |
| AD12964 | (NAG37)s(invAb)sgaugaggaUfuUfGfgguuuucuas(invAb) | 1086 |
| AD12965 | (NAG37)s(invAb)sgaugaggaUfuUfGfgguuuucuas(invAb) | 1086 |
| AD12966 | (NAG37)s(invAb)sgaugagGfaUfuUfgggguuuucuas(invAb) | 1088 |
| AD12967 | (NAG37)s(invAb)sgaugagGfaUfuUfgggguuuucuas(invAb) | 1088 |
| AD12968 | (NAG37)s(invAb)sgaugaggaUfuUfGfgguuuucuas(invAb) | 1086 |
| AD12969 | (NAG37)s(invAb)sgaugaggaUfuUfGfgguuuucuas(invAb) | 1086 |
| AD12970 | (NAG37)s(invAb)sgaugagGfaUfuUfgggguuuucuas(invAb) | 1088 |
| AD12971 | (NAG37)s(invAb)sgaugagGfaUfuUfgggguuuucuas(invAb) | 1088 |
| AD13036 | (NAG37)s(invAb)sgcugugGfuGfuCfugaguacuuus(invAb) | 1131 |
| AD13037 | (NAG37)s(invAb)sgcugugGfuGfuCfugaguacuuus(invAb) | 1131 |
| AD13038 | (NAG37)s(invAb)sgcugugGfuGfuCfugaguacuuus(invAb) | 1131 |
| AD13039 | (NAG37)s(invAb)sgcugugGfuGfuCfugaguacuuus(invAb) | 1131 |
| AD13040 | (NAG37)s(invAb)sgcugugGfuGfuCfugaguacuuus(invAb) | 1131 |
| AD13041 | (NAG37)s(invAb)sgcugugGfuGfuCfugaguacuuus(invAb) | 1131 |
| AD13123 | (NAG37)s(invAb)sgcugugGfuGfuCfugaguacuuus(invAb) | 1131 |
| AD13124 | (NAG37)s(invAb)sgcugugGfuGfuCfugaguacuuus(invAb) | 1131 |
| AD13125 | (NAG37)s(invAb)sgcugugGfuGfuCfugaguacuuus(invAb) | 1131 |
| AD13126 | (NAG37)s(invAb)sgcugugguGfUfCfugaguacuuus(invAb) | 1077 |
| AD13127 | (NAG37)s(invAb)sgcugugguGfUfCfugaguacuuus(invAb) | 1077 |
| AD13128 | (NAG37)s(invAb)sgcugugGfuGfuCfugaguacuuus(invAb) | 1131 |
| AD13382 | (NAG37)s(invAb)sgaugaggaUfuUfGfgguuuucuas(invAb) | 1086 |
| AD13383 | (NAG37)s(invAb)sgaugaggaUfuUfGfgguuuucuas(invAb) | 1086 |
| AD13384 | (NAG37)s(invAb)sgaugaggaUfuUfGfgguuuucuas(invAb) | 1086 |
| AD13385 | (NAG37)s(invAb)sgaugaggaUfuUfGfgguuuucuas(invAb) | 1086 |

TABLE 5C-continued

CFB RNAi Agent Duplexes Showing Chemically Modified Antisense
Strand and Sense Strand Sequences

| | | |
|---|---|---|
| AD13386 | (NAG37)s(invAb)sgaugaggaUfuUfGfgguuuucuas(invAb) | 1086 |
| AD13387 | (NAG37)s(invAb)sgaugaggaUfuUfGfgguuuucuas(invAb) | 1086 |
| AD13388 | (NAG37)s(invAb)sgaugaggaUfuUfGfgguuuucuas(invAb) | 1086 |
| AD13389 | (NAG37)s(invAb)sgaugaggaUfuuGfgguuuucuas(invAb) | 1132 |
| AD13390 | (NAG37)s(invAb)sgaugaggadTuudGgguuuucuas(invAb) | 1133 |
| AD13391 | (NAG37)s(invAb)sggugaggaUfuUfGfgguuuucuas(invAb) | 1134 |
| AD13392 | (NAG37)s(invAb)sgcugaggaUfuUfGfgguuuucuas(invAb) | 1135 |
| AD13435 | (NAG37)s(invAb)sgcugugguGfUfCfugaguacuuus(invAb) | 1077 |
| AD13436 | (NAG37)s(invAb)sgcugugguGfUfCfugaguacuuas(invAb) | 1136 |
| AD13437 | (NAG37)s(invAb)sgcugugguGfUfCfugaguacuuus(invAb) | 1077 |
| AD13438 | (NAG37)s(invAb)sgcugugguGfUfCfugaguacuuus(invAb) | 1077 |
| AD13439 | (NAG37)s(invAb)sgcugugguGfUfCfugaguacuuus(invAb) | 1077 |
| AD13440 | (NAG37)s(invAb)sgcugugguGfUfCfugaguacuuus(invAb) | 1077 |
| AD13441 | (NAG37)s(invAb)sgcugugguGfUfCfugaguacuuus(invAb) | 1077 |
| AD13442 | (NAG37)s(invAb)sgcuguggudGudCugaguacuuus(invAb) | 1137 |
| AD13443 | (NAG37)s(invAb)sgcugugguGfUfCfugaguacuuus(invAb) | 1077 |
| AD13534 | (NAG37)s(invAb)sagaugaggAfUfUfugggguuuucus(invAb) | 1138 |
| AD13585 | (NAG37)s(invAb)sgaugaggaUfuUfGfgguuuucuas(invAb) | 1086 |
| AD13586 | (NAG37)s(invAb)sgcugugguGfUfCfugaguacuuus(invAb) | 1077 |
| AD13616 | (NAG37)s(invAb)sgaugaggaUfuUfGfgguuuucuas(invAb) | 1086 |
| AD13647 | (NAG37)s(invAb)sgaugaggaUfuUfGfgguuuucuas(invAb) | 1086 |
| AD13648 | (NAG37)s(invAb)sgaugaggaUfuUfGfgguuuucuas(invAb) | 1086 |
| AD13649 | (NAG37)s(invAb)sgaugaggaUfuUfGfgguuuucuas(invAb) | 1086 |
| AD13650 | (NAG37)s(invAb)sgaugaggaUfuUfgggguuuucuas(invAb) | 1139 |
| AD13651 | (NAG37)s(invAb)sgaugaggaUuUfgggguuuucuas(invAb) | 1140 |
| AD13652 | (NAG37)s(invAb)sgaugaggaUfuUgggguuuucuas(invAb) | 1141 |
| AD13653 | (NAG37)s(invAb)sgaugaggadTuUfgggguuuucuas(invAb) | 1142 |
| AD13654 | (NAG37)s(invAb)sgaugaggaUfudTgggguuuucuas(invAb) | 1143 |
| AD13655 | (NAG37)s(invAb)sgaugaggadTudTgggguuuucuas(invAb) | 1144 |
| AD13656 | (NAG37)s(invAb)sgaugaggaUudTgggguuuucuas(invAb) | 1145 |
| AD13657 | (NAG37)s(invAb)sgaugaggadTuUgggguuuucuas(invAb) | 1146 |
| AD13816 | (NAG37)s(invAb)sgaugaggaUfuUfGfgguuuucuas(invAb) | 1086 |
| AD13817 | (NAG37)s(invAb)sugaggaUfuUfGfgguuuucuas(invAb) | 1147 |
| AD13818 | (NAG37)s(invAb)sugaggaUfuUfGfgguuuucuas(invAb) | 1147 |
| AD13819 | (NAG37)susgaggaUfuUfGfgguuuucuas(invAb) | 1148 |
| AD13930 | (NAG37)s(invAb)sgcugugguGfUfCfugaguacuuas(invAb) | 1136 |
| AD13931 | (NAG37)s(invAb)sgcugugguGfUfCfugaguacuuas(invAb) | 1136 |
| AD13932 | (NAG37)s(invAb)sgcugugguGfUfCfugaguacuuas(invAb) | 1136 |
| AD13933 | (NAG37)s(invAb)sgcugugguGfUfCfugaguacuuas(invAb) | 1136 |

TABLE 5C-continued

CFB RNAi Agent Duplexes Showing Chemically Modified Antisense
Strand and Sense Strand Sequences

| | | |
|---|---|---|
| AD13934 | (NAG37)s(invAb)sgcuguggUGfUfCfugaguacuuas(invAb) | 1136 |
| AD13935 | (NAG37)s(invAb)sgcuguggUGfUfUfugaguacuuas(invAb) | 1149 |
| AD13946 | (NAG37)s(invAb)sggacccaaUfUfAfcugucauugas(invAb) | 1115 |
| AD13947 | (NAG37)s(invAb)sggacccaaUfUfAfcugucauugas(invAb) | 1115 |
| AD13948 | (NAG37)s(invAb)sggacccaaUfUfAfcugucauugas(invAb) | 1115 |
| AD13949 | (NAG37)s(invAb)sggacccaaUfUfAfcugucauugas(invAb) | 1115 |
| AD13950 | (NAG37)s(invAb)sggacccaaUfUfAfcugucauugas(invAb) | 1115 |
| AD13951 | (NAG37)s(invAb)sggacccaaUfUfAfcugucauugas(invAb) | 1115 |
| AD13952 | (NAG37)s(invAb)sggacccaaUfUfAfcugucauugas(invAb) | 1115 |
| AD13953 | (NAG37)s(invAb)sggacccaaUfUfAfcugucauugas(invAb) | 1115 |
| AD13954 | (NAG37)s(invAb)sggacccaaUfUfAfcugucauugas(invAb) | 1115 |
| AD13955 | (NAG37)s(invAb)sggacccaaUfuAfcugucauugas(invAb) | 1150 |
| AD13956 | (NAG37)s(invAb)sggacccaaUfuAfCfugucauugas(invAb) | 1151 |
| AD13957 | (NAG37)s(invAb)sggacccAfaUfuAfcugucauugas(invAb) | 1152 |
| AD13958 | (NAG37)s(invAb)sggacccaaUfUfAfcugucauugas(invAb) | 1115 |
| AD14126 | (NAG37)s(invAb)sgaugaggaUfuUfGfgguuuucuas(invAb) | 1086 |
| AD14127 | (NAG37)s(invAb)sgaugaggaUfuUfGfgguuuucuas(invAb) | 1086 |
| AD14128 | (NAG37)s(invAb)sgaugaggaUfuUfGfgguuuucuas(invAb) | 1086 |
| AD14129 | (NAG37)s(invAb)sgaugaggaUfuUfGfgguuuucuas(invAb) | 1086 |
| AD14130 | (NAG37)s(invAb)sgaugaggaUfuUfGfgguuuucuas(invAb) | 1086 |
| AD14160 | (NAG37)s(invAb)sgaugaggaUfuUfGfgguuuucuas(invAb) | 1086 |
| AD14221 | (NAG37)s(invAb)suguggUGfUfCfugaguacuuus(invAb) | 1153 |
| AD14222 | (NAG37)s(invAb)suguggUGfUfCfugaguacuuus(invAb) | 1153 |
| AD14223 | (NAG37)s(invAb)suguggUGfUfCfugaguacuuus(invAb) | 1153 |
| AD14224 | (NAG37)s(invAb)scguggUGfUfCfugaguacuuus(invAb) | 1154 |
| AD14225 | (NAG37)s(invAb)sgguggUGfUfCfugaguacuuus(invAb) | 1155 |
| AD14226 | (NAG37)s(invAb)sgcuguggUGfUfUfugaguacuuas(invAb) | 1149 |
| AD14227 | (NAG37)s(invAb)sgcuguggUGfUfUfugaguacuuas(invAb) | 1149 |
| AD14230 | (NAG37)sgcuguggUGfUfCfugaguacuuas(invAb) | 1156 |
| AD14231 | (NAG37)s(invAb)sgcuguggUGfUfCfugaguacuuas(invAb) | 1136 |
| AD14232 | (NAG37)s(invAb)sgcuguggUGfUfCfugaguacuuas(invAb) | 1136 |
| AD14233 | (NAG37)s(invAb)sgcuguggUGfUfCfugaguacuuas(invAb) | 1136 |
| AD14234 | (NAG37)s(invAb)sgcuguggUGfUfCfugaguacuuas(invAb) | 1136 |
| AD14235 | (NAG37)s(invAb)sgcuguggUGfUfCfugaguacuuas(invAb) | 1136 |
| AD14270 | (NAG37)s(invAb)sgaugaggaUfuUfGfgguuuucuas(invAb) | 1086 |
| AD14271 | (NAG37)s(invAb)sggugaggaUfuUfGfgguuuucuas(invAb) | 1134 |
| AD14272 | (NAG37)s(invAb)sgaugaggaUfuUfGfgguuuucuas(invAb) | 1086 |
| AD14273 | (NAG37)s(invAb)sgaugaggaUfuUfGfgguuuucuas(invAb) | 1086 |

TABLE 5C-continued

CFB RNAi Agent Duplexes Showing Chemically Modified Antisense
Strand and Sense Strand Sequences

| | | |
|---|---|---|
| AD14274 | (NAG37)s(invAb)sggugaggaUfuUfGfgguuuucuas(invAb) | 1134 |
| AD14275 | (NAG37)s(invAb)sgaugaggaUfuUfGfgguuuucuas(invAb) | 1086 |
| AD14276 | (NAG37)s(invAb)sgaugagGfaUfuUfggguuuucuas(invAb) | 1088 |
| AD14277 | (NAG37)s(invAb)sggugagGfaUfuUfggguuuucuas(invAb) | 1157 |
| AD14278 | (NAG37)s(invAb)sgaugagGfaUfuUfggguuuucuas(invAb) | 1088 |
| AD14279 | (NAG37)s(invAb)sgaugaggaUfuUfGfgguuuucuas(invAb) | 1086 |
| AD14280 | (NAG37)s(invAb)sggugaggaUfuUfGfgguuuucuas(invAb) | 1134 |
| AD14281 | (NAG37)s(invAb)sgaugaggaUfuUfGfgguuuucuas(invAb) | 1086 |
| AD14282 | (NAG37)s(invAb)sgaugaggaUfuUfGfgguuuucuas(invAb) | 1086 |
| AD14283 | (NAG37)s(invAb)sggugaggaUfuUfGfgguuuucuas(invAb) | 1134 |
| AD14284 | (NAG37)s(invAb)sgaugaggaUfuUfGfgguuuucuas(invAb) | 1086 |
| AD14386 | (NAG37)sgsgugguGfUfCfugaguacuuus(invAb) | 1158 |
| AD14387 | (NAG37)scsgugguGfUfCfugaguacuuus(invAb) | 1159 |
| AD14388 | (NAG37)susgugguGfUfCfugaguacuuus(invAb) | 1160 |
| AD14389 | (NAG37)s(invAb)sgguggUfUfCfugaguacuuus(invAb) | 1155 |
| AD14390 | (NAG37)sgsgugguGfUfCfugaguacuuus(invAb) | 1158 |
| AD14391 | (NAG37)sgsgugguGfUfCfugaguacuus(invdA) | 1161 |
| AD14392 | (NAG37)sgsgugguGfUfCfugaguacuuus(invAb) | 1158 |
| AD14393 | (NAG37)s(invAb)sgguggUfUfCfugaguacuuus(invAb) | 1155 |
| AD14394 | (NAG37)sgsgugguGfUfCfugaguacuuus(invAb) | 1158 |
| AD14395 | (NAG37)s(invAb)sgguggUfUfCfugaguacuus(invAb) | 1155 |
| AD14396 | (NAG37)s(invAb)sgguggUfUfCfugaguacuus(invAb) | 1155 |
| AD14397 | (NAG37)s(invAb)sgaugaggaUfuUfGfgguuuucuas(invAb) | 1086 |
| AD14398 | (NAG37)s(invAb)sugaggaUfuUfGfgguuuucuas(invAb) | 1147 |
| AD14399 | (NAG37)s(invAb)sggaggaUfuUfGfgguuuucuas(invAb) | 1162 |
| AD14400 | (NAG37)s(invAb)scgaggaUfuUfGfgguuuucuas(invAb) | 1163 |
| AD14515 | (NAG37)s(invAb)sgcuguaguGfUfCfugaguacuuas(invAb) | 1164 |
| AD14516 | (NAG37)s(invAb)sgcuaugguGfUfCfugaguacuuas(invAb) | 1165 |
| AD14517 | (NAG37)s(invAb)sgcugugguGfUfCfugaguacuuas(invAb) | 1136 |
| AD14518 | (NAG37)s(invAb)sgcugugguGfUfCfugaguacuuas(invAb) | 1136 |
| AD14570 | (NAG37)s(invAb)sgcugugguGfUfCfugaguacuuus(invAb) | 1077 |
| AD14571 | (NAG37)s(invAb)sgcugugguGfUfCfugaguacuuus(invAb) | 1077 |
| AD14637 | (NAG37)s(invAb)sgcugugguGfUfGfugaguacuuus(invAb) | 1166 |
| AD14638 | (NAG37)s(invAb)sgcuguuguGfUfGfugaggacuuas(invAb) | 1167 |
| AC003560 | (NAG37)s(invAb)sacugugguGfUfCfugaguacuuus(invAb) | 1433 |
| AC005224 | (NAG37)s(invAb)sggugguGfUfCfugaguacuuas(invAb) | 1434 |

($A^{2N}$) = 2-aminoadenine-containing nucleotide; I = hypoxanthine (inosine) nucleotide In some embodiments, a CFB RNAi agent is prepared or provided as a salt, mixed salt, or a free-acid. In some embodiments, a CFB RNAi agent is prepared or provided as a pharmaceutically acceptable salt, such as a sodium or potassium salt. In some embodiments, a CFB RNAi agent is prepared or provided as a sodium salt. The RNAi agents described herein, upon delivery to a cell expressing a CFB gene, inhibit or knockdown expression of one or more CFB genes in vivo and/or in vitro.

Targeting Ligands or Groups, Linking Groups, and Delivery Vehicles

In some embodiments, a CFB RNAi agent is conjugated to one or more non-nucleotide groups including, but not limited to, a targeting group, a linking group, a targeting ligand, a delivery polymer, or a delivery vehicle. The non-nucleotide group can enhance targeting, delivery or attachment of the RNAi agent. Examples of targeting groups and linking groups are provided in Table 6. The non-nucleotide group can be covalently linked to the 3' and/or 5' end of either the sense strand and/or the antisense strand. In some embodiments, a CFB RNAi agent contains a non-nucleotide group linked to the 3' and/or 5' end of the sense strand. In some embodiments, a non-nucleotide group is linked to the 5' end of a CFB RNAi agent sense strand. A non-nucleotide group may be linked directly or indirectly to the RNAi agent via a linker/linking group. In some embodiments, a non-nucleotide group is linked to the RNAi agent via a labile, cleavable, or reversible bond or linker.

In some embodiments, a non-nucleotide group enhances the pharmacokinetic or biodistribution properties of an RNAi agent or conjugate to which it is attached to improve cell- or tissue-specific distribution and cell-specific uptake of the RNAi agent or conjugate. In some embodiments, a non-nucleotide group enhances endocytosis of the RNAi agent.

Targeting groups or targeting moieties enhance the pharmacokinetic or biodistribution properties of a conjugate or RNAi agent to which they are attached to improve cell-specific (including, in some cases, organ specific) distribution and cell-specific (or organ specific) uptake of the conjugate or RNAi agent. A targeting group can be mon-ovalent, divalent, trivalent, tetravalent, or have higher valency for the target to which it is directed. Representative targeting groups include, without limitation, compounds with affinity to cell surface molecules, cell receptor ligands, haptens, antibodies, monoclonal antibodies, antibody fragments, and antibody mimics with affinity to cell surface molecules.

In some embodiments, a targeting group is linked to an RNAi agent using a linker, such as a PEG linker or one, two, or three abasic and/or ribitol (abasic ribose) residues, which can in some instances serve as linkers. In some embodiments, a targeting ligand comprises a galactose-derivative cluster.

The CFB RNAi agents described herein can be synthesized having a reactive group, such as an amino group (also referred to herein as an amine), at the 5'-terminus and/or the 3'-terminus. The reactive group can be used subsequently to attach a targeting moiety using methods typical in the art.

In some embodiments, a targeting group comprises an asialoglycoprotein receptor ligand. As used herein, an asialoglycoprotein receptor ligand is a ligand that contains a moiety having affinity for the asialoglycoprotein receptor. As noted herein, the asialoglycoprotein receptor is highly expressed on hepatocytes. In some embodiments, an asialoglycoprotein receptor ligand includes or consists of one or more galactose derivatives. As used herein, the term galactose derivative includes both galactose and derivatives of galactose having affinity for the asialoglycoprotein receptor that is equal to or greater than that of galactose. Galactose derivatives include, but are not limited to: galactose, galactosamine, N-formylgalactosamine, N-acetyl-galactosamine, N-propionyl-galactosamine, N-n-butanoyl-galactosamine, and N-iso-butanoylgalactos-amine (see for example: S. T. Iobst and K. Drickamer, J. B. C., 1996, 271, 6686). Galactose derivatives, and clusters of galactose derivatives, that are useful for in vivo targeting of oligonucleotides and other molecules to the liver are known in the art (see, for example, Baenziger and Fiete, 1980, Cell, 22, 611-620; Connolly et al., 1982, J. Biol. Chem., 257, 939-945).

Galactose derivatives have been used to target molecules to hepatocytes in vivo through their binding to the asialoglycoprotein receptor expressed on the surface of hepatocytes. Binding of asialoglycoprotein receptor ligands to the asialoglycoprotein receptor(s) facilitates cell-specific targeting to hepatocytes and endocytosis of the molecule into hepatocytes. Asialoglycoprotein receptor ligands can be monomeric (e.g., having a single galactose derivative, also referred to as monovalent or monodentate) or multimeric (e.g., having multiple galactose derivatives). The galactose derivative or galactose derivative cluster can be attached to the 3' or 5' end of the sense or antisense strand of the RNAi agent using methods known in the art.

The preparation of targeting ligands, such as galactose derivative clusters, is described in, for example, International Patent Application Publication No. WO 2018/044350 to Arrowhead Pharmaceuticals, Inc., and International Patent Application Publication No. WO 2017/156012 to Arrowhead Pharmaceuticals, Inc., the contents of both of which are incorporated by reference herein in their entirety.

As used herein, a galactose derivative cluster comprises a molecule having two to four terminal galactose derivatives. A terminal galactose derivative is attached to a molecule through its C-1 carbon. In some embodiments, the galactose derivative cluster is a galactose derivative trimer (also referred to as tri-antennary galactose derivative or trivalent galactose derivative). In some embodiments, the galactose derivative cluster comprises N-acetyl-galactosamine moieties. In some embodiments, the galactose derivative cluster comprises three N-acetyl-galactosamine moieties. In some embodiments, the galactose derivative cluster is a galactose derivative tetramer (also referred to as tetra-antennary galactose derivative or tetra-valent galactose derivative). In some embodiments, the galactose derivative cluster comprises four N-acetyl-galactosamine moieties.

As used herein, a galactose derivative trimer contains three galactose derivatives, each linked to a central branch point. As used herein, a galactose derivative tetramer contains four galactose derivatives, each linked to a central branch point. The galactose derivatives can be attached to the central branch point through the C-1 carbons of the saccharides. In some embodiments, the galactose derivatives are linked to the branch point via linkers or spacers. In some embodiments, the linker or spacer is a flexible hydrophilic spacer, such as a PEG group (see, e.g., U.S. Pat. No. 5,885,968; Biessen et al. J. Med. Chem. 1995 Vol. 39 p. 1538-1546). In some embodiments, the PEG spacer is a PEG3 spacer. The branch point can be any small molecule which permits attachment of three galactose derivatives and further permits attachment of the branch point to the RNAi agent. An example of branch point group is a di-lysine or di-glutamate. Attachment of the branch point to the RNAi agent can occur through a linker or spacer. In some embodiments, the linker or spacer comprises a flexible hydrophilic spacer, such as, but not limited to, a PEG spacer. In some embodiments, the linker comprises a rigid linker, such as a cyclic group. In some embodiments, a galactose derivative comprises or consists of N-acetyl-galactosamine. In some embodiments, the galactose derivative cluster is comprised of a galactose derivative tetramer, which can be, for example, an N-acetyl-galactosamine tetramer.

Embodiments of the present disclosure include pharmaceutical compositions for delivering a CFB RNAi agent to a liver cell in vivo. Such pharmaceutical compositions can include, for example, a CFB RNAi agent conjugated to a galactose derivative cluster. In some embodiments, the galactose derivative cluster is comprised of a galactose derivative trimer, which can be, for example, an N-acetyl-galactosamine trimer, or galactose derivative tetramer, which can be, for example, an N-acetyl-galactosamine tetramer.

A targeting ligand or targeting group can be linked to the 3' or 5' end of a sense strand or an antisense strand of a CFB RNAi agent disclosed herein.

Targeting ligands include, but are not limited to (NAG37) and (NAG37)s as defined in Table 6. Other targeting groups and targeting ligands, including galactose cluster targeting ligands, are known in the art.

In some embodiments, a linking group is conjugated to the RNAi agent. The linking group facilitates covalent linkage of the agent to a targeting group, delivery polymer, or delivery vehicle. The linking group can be linked to the 3' and/or the 5' end of the RNAi agent sense strand or antisense strand. In some embodiments, the linking group is linked to the RNAi agent sense strand. In some embodiments, the linking group is conjugated to the 5' or 3' end of an RNAi agent sense strand. In some embodiments, a linking group is conjugated to the 5' end of an RNAi agent sense strand. Examples of linking groups, can include, but are not limited to: reactive groups such a primary amines and alkynes, alkyl groups, abasic nucleotides, ribitol (abasic ribose), and/or PEG groups.

In some embodiments, a targeting group is linked internally to a nucleotide on the sense strand and/or the antisense strand of the RNAi agent. In some embodiments, a targeting group is linked to the RNAi agent via a linker.

A linker or linking group is a connection between two atoms that links one chemical group (such as an RNAi agent) or segment of interest to another chemical group (such as a targeting group or delivery polymer) or segment of interest via one or more covalent bonds. A labile linkage contains a labile bond. A linkage can optionally include a spacer that increases the distance between the two joined atoms. A spacer can further add flexibility and/or length to the linkage. Spacers include, but are not be limited to, alkyl groups, alkenyl groups, alkynyl groups, aryl groups, aralkyl groups, aralkenyl groups, and aralkynyl groups; each of which can contain one or more heteroatoms, heterocycles, amino acids, nucleotides, and saccharides. Spacer groups are well known in the art and the preceding list is not meant to limit the scope of the description.

In some embodiments, when two or more RNAi agents are included in a single composition, each of the RNAi agents may be linked to the same targeting group or two a different targeting groups (i.e., targeting groups having different chemical structure). In some embodiments, targeting groups are linked to the CFB RNAi agents disclosed herein without the use of an additional linker. In some embodiments, the targeting group itself is designed having a linker or other site to facilitate conjugation readily present. In some embodiments, when two or more CFB RNAi agents are included in a single molecule, each of the RNAi agents may utilize the same linker or different linkers (i.e., linkers having different chemical structures).

Any of the CFB RNAi agent nucleotide sequences listed in Tables 2, 3, 4A, 4B, or 5C, whether modified or unmodified, can contain 3' and/or 5' targeting group(s) or linking group(s). Any of the CFB RNAi agent sequences listed in Table 3 or 4, or are otherwise described herein, which contain a 3' or 5' targeting group or linking group, can alternatively contain no 3' or 5' targeting group or linking group, or can contain a different 3' or 5' targeting group or linking group including, but not limited to, those depicted in Table 6. Any of the CFB RNAi agent duplexes listed in Tables 5A, 5B, and 5C, whether modified or unmodified, can further comprise a targeting group or linking group, including, but not limited to, those depicted in Table 6, and the targeting group or linking group can be attached to the 3' or 5' terminus of either the sense strand or the antisense strand of the CFB RNAi agent duplex. Examples of targeting groups and linking groups (which when combined can form targeting ligands) are provided in Table 6. Table 4A, Table 4B, and Table 5C provide certain embodiments of CFB RNAi agent sense strands having a targeting group or linking group linked to the 5' or 3' end.

TABLE 6

Structures Representing Various Modified Nucleotides, Targeting Ligands or Targeting Groups, Capping Residues, and Linking Groups

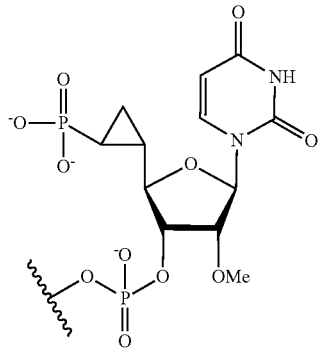

cPrpu

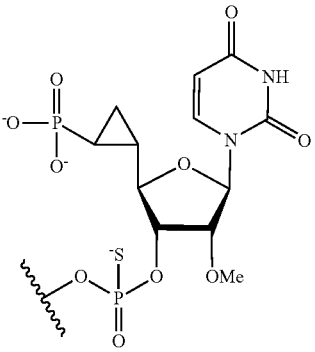

cPrpus

TABLE 6-continued
Structures Representing Various Modified Nucleotides, Targeting Ligands or Targeting Groups, Capping Residues, and Linking Groups
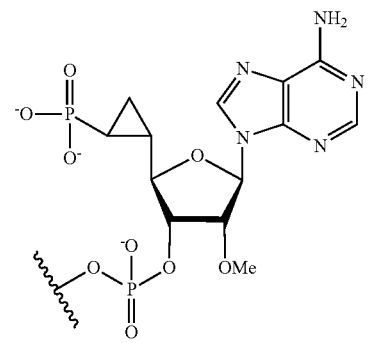
cPrpa
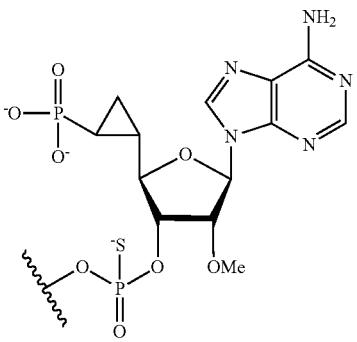
cPrpas
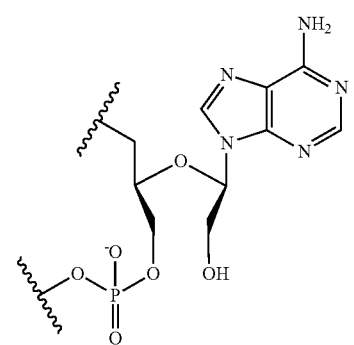
$A_{UNA}$
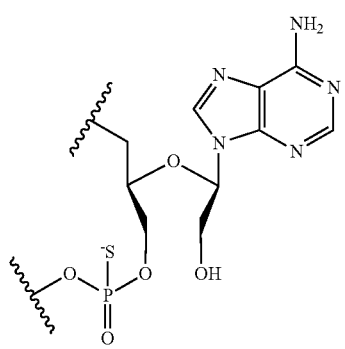
$A_{UNA}s$
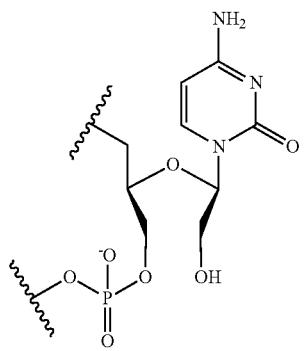
$C_{UNA}$
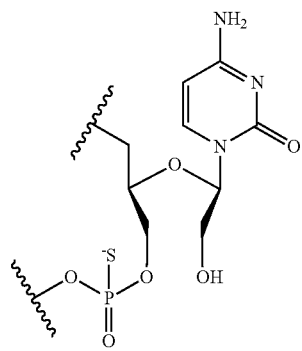
$C_{UNA}s$
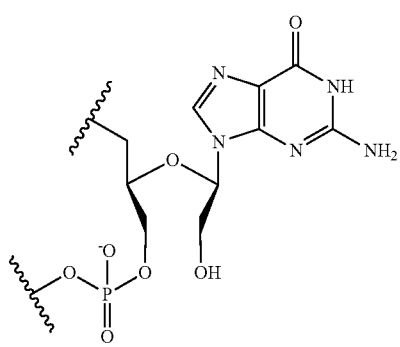
$GU_{NA}$
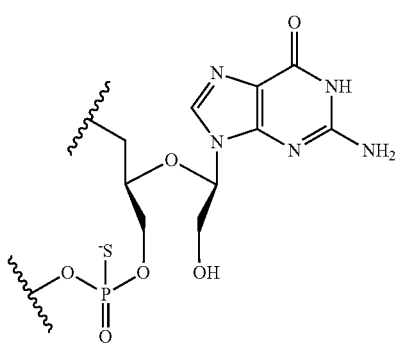
$G_{UNA}s$ TABLE 6-continued Structures Representing Various Modified Nucleotides, Targeting Ligands or Targeting Groups, Capping Residues, and Linking Groups

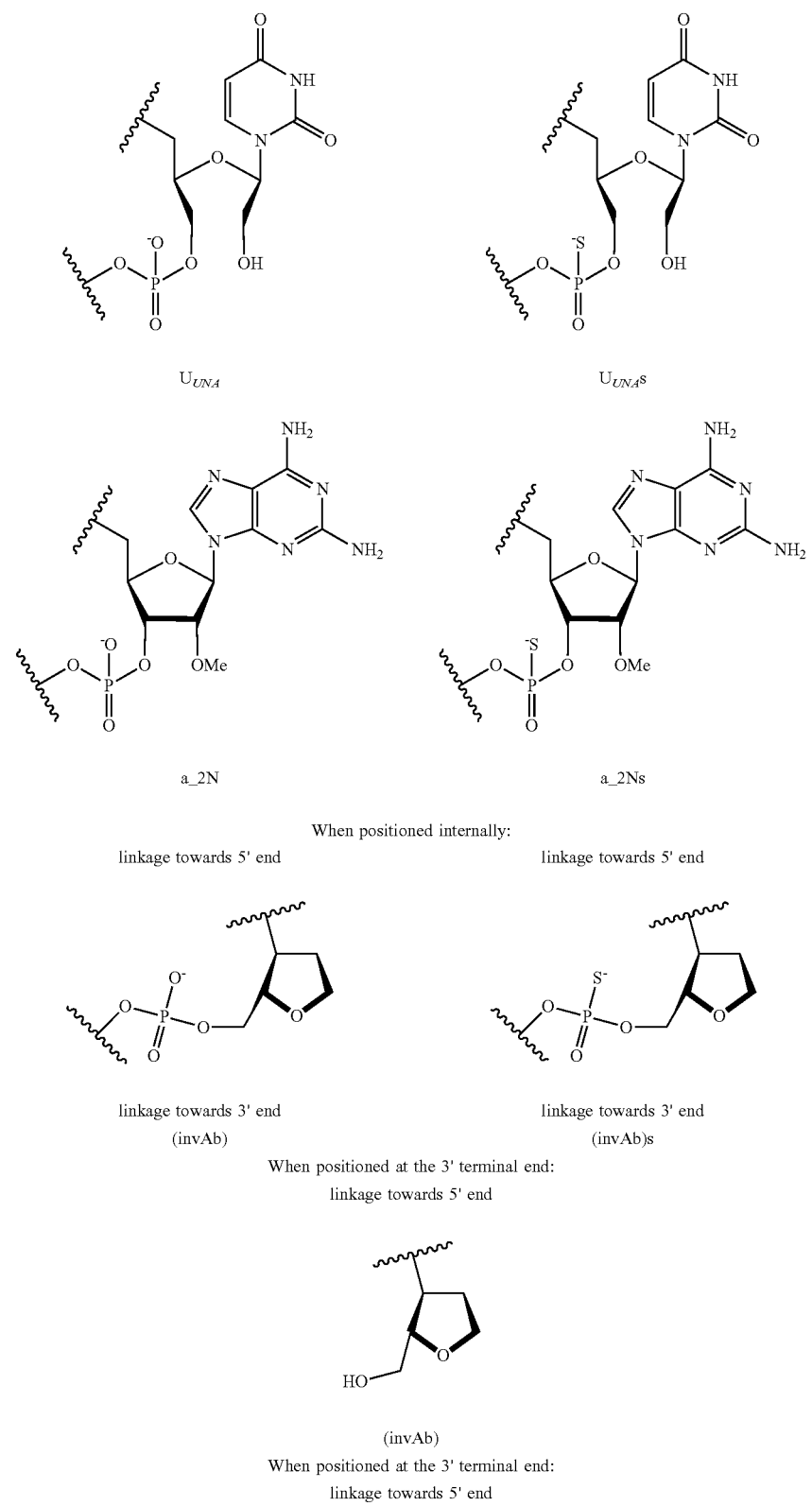

U$_{UNA}$          U$_{UNA}$s a_2N          a_2Ns

When positioned internally:
linkage towards 5' end          linkage towards 5' end linkage towards 3' end          linkage towards 3' end
(invAb)          (invAb)s When positioned at the 3' terminal end:
linkage towards 5' end (invAb)
When positioned at the 3' terminal end:
linkage towards 5' end TABLE 6-continued Structures Representing Various Modified Nucleotides, Targeting Ligands or Targeting Groups, Capping Residues, and Linking Groups

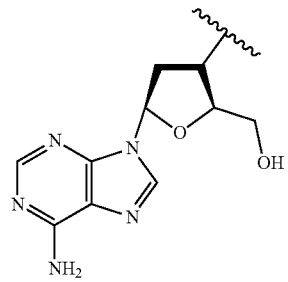

(invdA)

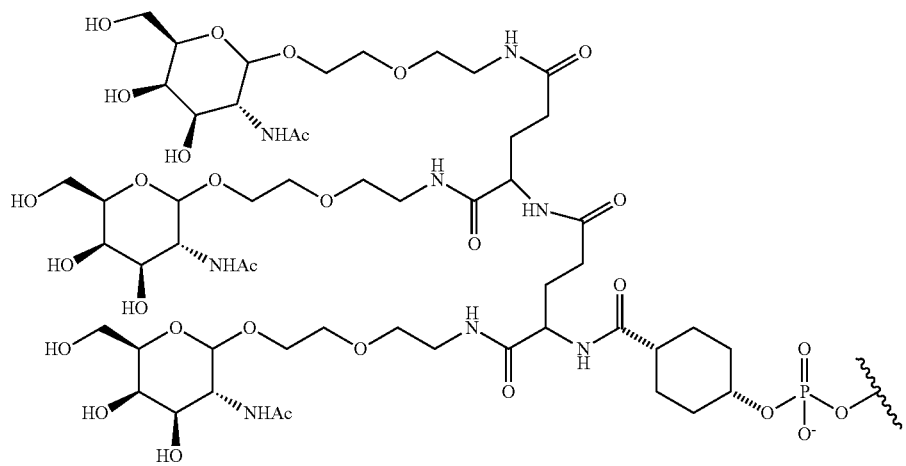 [SMILES: *OP(=O)([O-])O[C@H]1CC[C@@H](C(=O)NC(CCC(=O)NC(CCC(=O)NCCOCCOC2O[C@H](CO)[C@H](O)[C@H](O)[C@H]2NC(C)=O)C(=O)NCCOCCOC2O[C@H](CO)[C@H](O)[C@H](O)[C@H]2NC(C)=O)C(=O)NCCOCCOC2O[C@H](CO)[C@H](O)[C@H](O)[C@H]2NC(C)=O)CC1]

(NAG37)

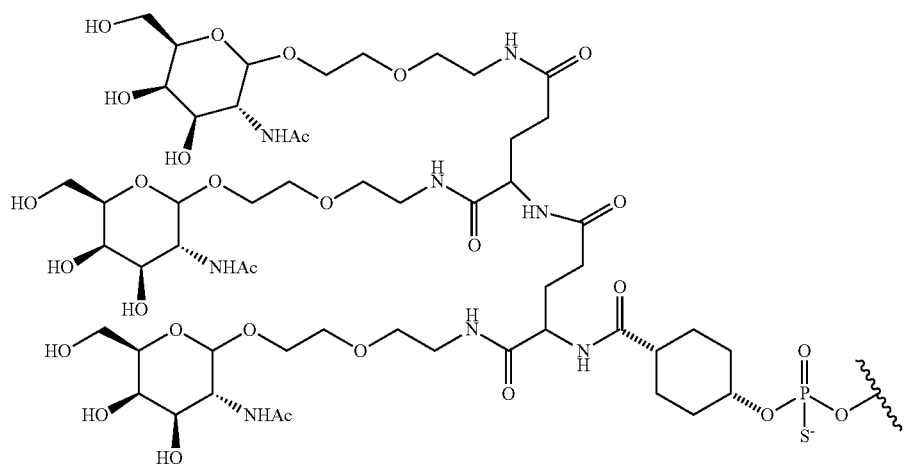 [SMILES: *OP(=O)([S-])O[C@H]1CC[C@@H](C(=O)NC(CCC(=O)NC(CCC(=O)NCCOCCOC2O[C@H](CO)[C@H](O)[C@H](O)[C@H]2NC(C)=O)C(=O)NCCOCCOC2O[C@H](CO)[C@H](O)[C@H](O)[C@H]2NC(C)=O)C(=O)NCCOCCOC2O[C@H](CO)[C@H](O)[C@H](O)[C@H]2NC(C)=O)CC1]

(NAG37)s

In each of the above structures in Table 6, NAG comprises an N-acetyl-galactosamine. In some embodiments, NAG as depicted in Table 6 above can comprise another galactose derivative that has affinity for the asialoglycoprotein receptor present on hepatocytes, as would be understood by a person of ordinary skill in the art to be attached in view of the structures above and description provided herein. Other linking groups known in the art may be used.

In some embodiments, a delivery vehicle can be used to deliver an RNAi agent to a cell or tissue. A delivery vehicle is a compound that improves delivery of the RNAi agent to a cell or tissue. A delivery vehicle can include, or consist of, but is not limited to: a polymer, such as an amphipathic polymer, a membrane active polymer, a peptide, a melittin peptide, a melittin-like peptide (MLP), a lipid, a reversibly modified polymer or peptide, or a reversibly modified membrane active polyamine. In some embodiments, the RNAi agents can be combined with lipids, nanoparticles, polymers, liposomes, micelles, DPCs or other delivery systems available in the art. The RNAi agents can also be chemically conjugated to targeting groups, lipids (including, but not limited to cholesterol and cholesteryl derivatives), nanoparticles, polymers, liposomes, micelles, DPCs (see, for example WO 2000/053722, WO 2008/0022309, WO 2011/104169, and WO 2012/083185, WO 2013/032829, WO 2013/158141, each of which is incorporated herein by reference), hydrogels, cyclodextrins, biodegradable nanocapsules, and bioadhesive microspheres, proteinaceous vectors, or other delivery systems suitable for nucleic acid or oligonucleotide delivery as known and available in the art.
Pharmaceutical Compositions The CFB RNAi agents disclosed herein can be prepared as pharmaceutical compositions or formulations (also referred to herein as "medicaments"). In some embodiments, pharmaceutical compositions include at least one CFB RNAi agent. These pharmaceutical compositions are particularly useful in the inhibition of the expression of the target mRNA in a target cell, a group of cells, a tissue, or an organism.

The pharmaceutical compositions can be used to treat a subject having a disease, disorder, or condition that would benefit from reduction in the level of the target CFB mRNA, or inhibition in expression of the target gene. The pharmaceutical compositions can be used to treat a subject at risk of developing a disease, disorder, symptom, or condition that would benefit from reduction of the level of the target mRNA or an inhibition in expression the target gene. In one embodiment, the method includes administering a CFB RNAi agent linked to a targeting ligand as described herein, to a subject to be treated. In some embodiments, one or more pharmaceutically acceptable excipients (including vehicles, carriers, diluents, and/or delivery polymers) are added to the pharmaceutical compositions that include a CFB RNAi agent, thereby forming a pharmaceutical formulation or medicament suitable for in vivo delivery to a subject, including a human.

The pharmaceutical compositions that include a CFB RNAi agent and methods disclosed herein decrease the level of the target mRNA in a cell, tissue, organ, or subject, including by administering to the subject a therapeutically effective amount of a herein described CFB RNAi agent, thereby inhibiting the expression or translation of CFB mRNA in the subject. In some embodiments, the subject has been previously identified or diagnosed as having IgA nephropathy (IgAN), C3 glomerulopathy (C3G), immune complex-mediated membranoproliferative glomerulonephritis (IC-MPGN), lupus nephritis (LN), Anti-Glomerular Basement Membrane disease (anti-GBM), ischemia reperfusion injury and T-cell mediated rejection (TCMR) in kidney transplantation, anti-neutrophil cytoplasmic antibody (ANCA)-associated vasculitis, age-related macular degeneration (AMD), including early and/or intermediate AMD, geographic atrophy (GA), glaucoma, Doyne honeycomb retinal dystrophy, paroxysmal nocturnal hemoglobinuria (PNH), atypical hemolytic uremic syndrome (aHUS), pre-eclampsia, rheumatoid arthritis (RA), and/or other complement-mediated diseases. In some embodiments, the subject would benefit from a reduction of CFB gene expression in the subject's liver.

In some embodiments, the described pharmaceutical compositions that include a CFB RNAi agent are used for treating or managing clinical presentations associated with IgA nephropathy, C3 glomerulopathy, and/or paroxysmal nocturnal hemoglobinuria (PNH). Other diseases or conditions for which a CFB RNAi agent may be useful include immune complex-mediated membranoproliferative glomerulonephritis (IC-MPGN), lupus nephritis (LN), Anti-Glomerular Basement Membrane disease (anti-GBM), ischemia reperfusion injury and T-cell mediated rejection (TCMR) in kidney transplantation, anti-neutrophil cytoplasmic antibody (ANCA)-associated vasculitis, age-related macular degeneration (AMD), including early and/or intermediate AMD, geographic atrophy (GA), glaucoma, Doyne honeycomb retinal dystrophy, atypical hemolytic uremic syndrome (aHUS), pre-eclampsia, rheumatoid arthritis (RA), and/or other complement-mediated diseases. In some embodiments, a therapeutically (including prophylactically) effective amount of one or more of pharmaceutical compositions is administered to a subject in need of such treatment. In some embodiments, administration of any of the disclosed CFB RNAi agents can be used to decrease the number, severity, and/or frequency of symptoms of a disease in a subject.

The described pharmaceutical compositions that include a CFB RNAi agent can be used to treat at least one symptom in a subject having a disease or disorder that would benefit from reduction or inhibition in expression of CFB mRNA and/or a reduction in CFB protein levels and/or a reduction in alternative complement pathway activity. Measuring CFB levels and alternative complement pathway activity can be conducted in accordance with established methods known in the art, including in accordance with the methods described in the Examples set forth herein.

In some embodiments, the subject is administered a therapeutically effective amount of one or more pharmaceutical compositions that include a CFB RNAi agent thereby treating the symptom. In other embodiments, the subject is administered a prophylactically effective amount of one or more CFB RNAi agents, thereby preventing or inhibiting the at least one symptom.

The route of administration is the path by which a CFB RNAi agent is brought into contact with the body. In general, methods of administering drugs and oligonucleotides and nucleic acids for treatment of a mammal are well known in the art and can be applied to administration of the compositions described herein. The CFB RNAi agents disclosed herein can be administered via any suitable route in a preparation appropriately tailored to the particular route. Thus, herein described pharmaceutical compositions can be administered by injection, for example, intravenously, intramuscularly, intracutaneously, subcutaneously, intraarticularly, or intraperitoneally. In some embodiments, the herein described pharmaceutical compositions are administered via subcutaneous injection.

The pharmaceutical compositions including a CFB RNAi agent described herein can be delivered to a cell, group of cells, tissue, or subject using oligonucleotide delivery technologies known in the art. In general, any suitable method recognized in the art for delivering a nucleic acid molecule (in vitro or in vivo) can be adapted for use with the compositions described herein. For example, delivery can be by local administration, (e.g., direct injection, implantation, or topical administering), systemic administration, or subcutaneous, intravenous, intraperitoneal, or parenteral routes, including intracranial (e.g., intraventricular, intraparenchymal and intrathecal), intramuscular, transdermal, airway (aerosol), nasal, oral, rectal, or topical (including buccal and sublingual) administration. In certain embodiments, the compositions are administered by subcutaneous or intravenous infusion or injection.

In some embodiments, the pharmaceutical compositions described herein comprise one or more pharmaceutically acceptable excipients. The pharmaceutical compositions described herein are formulated for administration to a subject.

As used herein, a pharmaceutical composition or medicament includes a pharmacologically effective amount of at least one of the described therapeutic compounds and one or more pharmaceutically acceptable excipients. Pharmaceutically acceptable excipients (excipients) are substances other than the Active Pharmaceutical Ingredient (API, therapeutic product, e.g., CFB RNAi agent) that are intentionally included in the drug delivery system. Excipients do not exert or are not intended to exert a therapeutic effect at the intended dosage. Excipients can act to a) aid in processing of the drug delivery system during manufacture, b) protect, support or enhance stability, bioavailability or patient acceptability of the API, c) assist in product identification, and/or d) enhance any other attribute of the overall safety, effectiveness, of delivery of the API during storage or use. A pharmaceutically acceptable excipient may or may not be an inert substance.

Excipients include, but are not limited to: absorption enhancers, anti-adherents, anti-foaming agents, anti-oxidants, binders, buffering agents, carriers, coating agents, colors, delivery enhancers, delivery polymers, detergents, dextran, dextrose, diluents, disintegrants, emulsifiers, extenders, fillers, flavors, glidants, humectants, lubricants, oils, polymers, preservatives, saline, salts, solvents, sugars, surfactants, suspending agents, sustained release matrices, sweeteners, thickening agents, tonicity agents, vehicles, water-repelling agents, and wetting agents.

Pharmaceutical compositions suitable for injectable use include sterile aqueous solutions (where water-soluble) or dispersions and sterile powders for the extemporaneous preparation of sterile injectable solutions or dispersion. For intravenous administration, suitable carriers include physiological saline, bacteriostatic water, Cremophor® EL™ (BASF, Parsippany, NJ) or phosphate buffered saline (PBS). Suitable carriers should be stable under the conditions of manufacture and storage and should be preserved against the contaminating action of microorganisms such as bacteria and fungi. The carrier can be a solvent or dispersion medium containing, for example, water, ethanol, polyol (for example, glycerol, propylene glycol, and liquid polyethylene glycol), and suitable mixtures thereof. The proper fluidity can be maintained, for example, by the use of a coating such as lecithin, by the maintenance of the required particle size in the case of dispersion and by the use of surfactants. In many cases, it will be preferable to include isotonic agents, for example, sugars, polyalcohols such as mannitol, sorbitol, and sodium chloride in the composition. Prolonged absorption of the injectable compositions can be brought about by including in the composition an agent which delays absorption, for example, aluminum monostearate and gelatin.

Sterile injectable solutions can be prepared by incorporating the active compound in the required amount in an appropriate solvent with one or a combination of ingredients enumerated above, as required, followed by filter sterilization. Generally, dispersions are prepared by incorporating the active compound into a sterile vehicle, which contains a basic dispersion medium and the required other ingredients from those enumerated above. In the case of sterile powders for the preparation of sterile injectable solutions, methods of preparation include vacuum drying and freeze-drying which yields a powder of the active ingredient plus any additional desired ingredient from a previously sterile-filtered solution thereof.

In some embodiments, pharmaceutical formulations that include the CFB RNAi agents disclosed herein suitable for subcutaneous administration can be prepared in an aqueous sodium phosphate buffer (e.g., the CFB RNAi agent formulated in 0.5 mM sodium phosphate monobasic, 0.5 mM sodium phosphate dibasic, in water). In some embodiments, pharmaceutical formulations that include the CFB RNAi agents disclosed herein suitable for subcutaneous administration can be prepared in water for injection (sterile water). CFB RNAi agents disclosed herein suitable for subcutaneous administration can be prepared in isotonic saline (0.9%).

Formulations suitable for intra-articular administration can be in the form of a sterile aqueous preparation of the drug that can be in microcrystalline form, for example, in the form of an aqueous microcrystalline suspension. Liposomal formulations or biodegradable polymer systems can also be used to present the drug for both intra-articular and ophthalmic administration.

Formulations suitable for oral administration of the CFB RNAi agents disclosed herein can also be prepared. In some embodiments, the CFB RNAi agents disclosed herein are administered orally. In some embodiments, the CFB RNAi agents disclosed herein are formulated in a capsule for oral administration.

The active compounds can be prepared with carriers that will protect the compound against rapid elimination from the body, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, and polylactic acid. Methods for preparation of such formulations will be apparent to those skilled in the art. Liposomal suspensions can also be used as pharmaceutically acceptable carriers. These can be prepared according to methods known to those skilled in the art, for example, as described in U.S. Pat. No. 4,522,811.

The CFB RNAi agents can be formulated in compositions in dosage unit form for ease of administration and uniformity of dosage. Dosage unit form refers to physically discrete units suited as unitary dosages for the subject to be treated; each unit containing a predetermined quantity of active compound calculated to produce the desired therapeutic effect in association with the required pharmaceutical carrier. The specification for the dosage unit forms of the disclosure are dictated by and directly dependent on the unique characteristics of the active compound and the therapeutic effect to be achieved, and the limitations inherent in the art of compounding such an active compound for the treatment of individuals.

A pharmaceutical composition can contain other additional components commonly found in pharmaceutical compositions. Such additional components include, but are not limited to: anti-pruritics, astringents, local anesthetics, analgesics, antihistamines, or anti-inflammatory agents (e.g., acetaminophen, NSAIDs, diphenhydramine, etc.). It is also envisioned that cells, tissues, or isolated organs that express or comprise the herein defined RNAi agents may be used as "pharmaceutical compositions." As used herein, "pharmacologically effective amount," "therapeutically effective amount," or simply "effective amount" refers to that amount of an RNAi agent to produce a pharmacological, therapeutic, or preventive result.

In some embodiments, the methods disclosed herein further comprise the step of administering a second therapeutic or treatment in addition to administering an RNAi agent disclosed herein. In some embodiments, the second therapeutic is another CFB RNAi agent (e.g., a CFB RNAi agent that targets a different sequence within the CFB target). In other embodiments, the second therapeutic can be a small molecule drug, an antibody, an antibody fragment, or an aptamer.

In some embodiments, the described CFB RNAi agent(s) are optionally combined with one or more additional therapeutics. The CFB RNAi agent and additional therapeutic(s) can be administered in a single composition or they can be administered separately. In some embodiments, the one or more additional therapeutics is administered separately in separate dosage forms from the RNAi agent (e.g., the CFB RNAi agent is administered by subcutaneous injection, while the additional therapeutic involved in the method of treatment dosing regimen is administered orally). In some embodiments, the described CFB RNAi agent(s) are administered to a subject in need thereof via subcutaneous injection, and the one or more optional additional therapeutics are administered orally, which together provide for a treatment regimen for diseases and conditions associated with dysregulation of the complement system, including IgA nephropathy (IgAN), C3 glomerulopathy (C3G), immune complex-mediated membranoproliferative glomerulonephritis (IC-MPGN), lupus nephritis (LN), Anti-Glomerular Basement Membrane disease (anti-GBM), ischemia reperfusion injury and T-cell mediated rejection (TCMR) in kidney transplantation, anti-neutrophil cytoplasmic antibody (ANCA)-associated vasculitis, age-related macular degeneration (AMD), including early and/or intermediate AMD, geographic atrophy (GA), glaucoma, Doyne honeycomb retinal dystrophy, paroxysmal nocturnal hemoglobinuria (PNH), atypical hemolytic uremic syndrome (aHUS), pre-eclampsia, rheumatoid arthritis (RA), and/or other complement-mediated diseases. In some embodiments, the described CFB RNAi agent(s) are administered to a subject in need thereof via subcutaneous injection, and the one or more optional additional therapeutics are administered via a separate subcutaneous injection. In some embodiments, the CFB RNAi agent and one or more additional therapeutics are combined into a single dosage form (e.g., a "cocktail" formulated into a single composition for subcutaneous injection). The CFB RNAi agents, with or without the one or more additional therapeutics, can be combined with one or more excipients to form pharmaceutical compositions.

Generally, an effective amount of a CFB RNAi agent will be in the range of from about 0.1 to about 100 mg/kg of body weight/dose, e.g., from about 1.0 to about 50 mg/kg of body weight/dose. In some embodiments, an effective amount of an active compound will be in the range of from about 0.25 to about 6 mg/kg of body weight per dose. In some embodiments, an effective amount of an active ingredient will be in the range of from about 0.5 to about 5 mg/kg of body weight per dose. In some embodiments, an effective amount of a CFB RNAi agent may be a fixed dose. In some embodiments, the fixed dose is in the range of from about 5 mg to about 1,000 mg of CFB RNAi agent. In some embodiments, the fixed does is in the range of 25 to 400 mg of CFB RNAi agent. Dosing may be weekly, bi-weekly, monthly, quarterly, or at any other interval depending on the dose of CFB RNAi agent administered, the activity level of the particular CFB RNAi agent, and the desired level of inhibition for the particular subject. The Examples herein show suitable levels for inhibition in certain animal species. The amount administered will depend on such variables as the overall health status of the patient or subject, the relative biological efficacy of the compound delivered, the formulation of the drug, the presence and types of excipients in the formulation, and the route of administration. Also, it is to be understood that the initial dosage administered can be increased beyond the above upper level to rapidly achieve the desired blood-level or tissue level, or the initial dosage can be smaller than the optimum.

For treatment of disease or for formation of a medicament or composition for treatment of a disease, the pharmaceutical compositions described herein including a CFB RNAi agent can be combined with an excipient or with a second therapeutic agent or treatment including, but not limited to: a second or other RNAi agent, a small molecule drug, an antibody, an antibody fragment, peptide and/or an aptamer.

The described CFB RNAi agents, when added to pharmaceutically acceptable excipients or adjuvants, can be packaged into kits, containers, packs, or dispensers. The pharmaceutical compositions described herein may be packaged in pre-filled syringes, pen injectors, autoinjectors, infusion bags/devices, or vials.

In some embodiments, the CFB RNAi Drug Substance is prepared or provided as a salt, mixed salt, or a free acid. In some embodiments, the form is a sodium salt.

In some embodiments, the CFB RNAi Agent is formulated with one or more pharmaceutically acceptable excipients to form a pharmaceutical composition suitable for administration to a human subject. In some embodiments, the CFB RNAi Agents described herein are formulated at 200 mg/mL in an aqueous sodium phosphate buffer (0.5 mM sodium phosphate monobasic, 0.5 mM sodium phosphate dibasic), which is suitable for subcutaneous administration in humans.

Methods of Treatment and Inhibition of Expression

The CFB RNAi agents disclosed herein can be used to treat a subject (e.g., a human or other mammal) having a disease or disorder that would benefit from administration of the RNAi agent. In some embodiments, the RNAi agents disclosed herein can be used to treat a subject (e.g., a human) that would benefit from reduction and/or inhibition in expression of CFB mRNA and/or CFB protein levels, for example, a subject that has been diagnosed with or is suffering from symptoms related to IgA nephropathy (IgAN), C3 glomerulopathy (C3G), immune complex-mediated membranoproliferative glomerulonephritis (IC-MPGN), lupus nephritis (LN), Anti-Glomerular Basement Membrane disease (anti-GBM), ischemia reperfusion injury and T-cell mediated rejection (TCMR) in kidney transplantation, anti-neutrophil cytoplasmic antibody (ANCA)-associated vasculitis, age-related macular degeneration (AMD), including early and/or intermediate AMD, geographic atrophy (GA), glaucoma, Doyne honeycomb retinal dystrophy, paroxysmal nocturnal hemoglobinuria (PNH), atypical hemolytic uremic syndrome (aHUS), pre-eclampsia, rheumatoid arthritis (RA), and/or other complement-mediated diseases.

In some embodiments, the subject is administered a therapeutically effective amount of any one or more CFB RNAi agents. Treatment of a subject can include therapeutic and/or prophylactic treatment. The subject is administered a therapeutically effective amount of any one or more CFB RNAi agents described herein. The subject may be an adult, adolescent, child, or infant. Administration of a pharmaceutical composition described herein can be to a human being or animal.

The CFB RNAi agents described herein can be used to treat at least one symptom in a subject having a CFB-related disease or disorder, or having a disease or disorder that is mediated at least in part by CFB gene expression. In some embodiments, the CFB RNAi agents are used to treat or manage a clinical presentation of a subject with a disease or disorder that would benefit from or be mediated at least in part by a reduction in CFB mRNA or CFB protein levels and/or a reduction in alternative pathway complement activity. The subject is administered a therapeutically effective amount of one or more of the CFB RNAi agents or CFB RNAi agent-containing compositions described herein. In some embodiments, the methods disclosed herein comprise administering a composition comprising a CFB RNAi agent described herein to a subject to be treated. In some embodiments, the subject is administered a prophylactically effective amount of any one or more of the described CFB RNAi agents, thereby treating the subject by preventing or inhibiting the at least one symptom.

In certain embodiments, the present disclosure provides methods for treatment of diseases, disorders, conditions, or pathological states mediated at least in part by CFB gene expression, in a patient in need thereof, wherein the methods include administering to the patient any of the CFB RNAi agents described herein.

In some embodiments, the gene expression level and/or mRNA level of a CFB gene in a subject to whom a described CFB RNAi agent is administered is reduced by at least about 30%, 35%, 40%, 45%, 50%, 55%, 60%, 65%, 70%, 75%, 80%, 85%, 95%, 96%, 97%, 98%, 99%, or greater than 99% relative to the subject prior to being administered the CFB RNAi agent or to a subject not receiving the CFB RNAi agent. The CFB mRNA level in the subject may be reduced in a cell, group of cells, and/or tissue of the subject. In some embodiments, the CFB gene expression is inhibited by at least about 30%, 35%, 40%, 45% 50%, 55%, 60%, 65%, or greater than 65% in hepatocytes relative to the subject prior to being administered the CFB RNAi agent or to a subject not receiving the CFB RNAi agent.

In some embodiments, the CFB protein level in a subject to whom a described CFB RNAi agent has been administered is reduced by at least about 30%, 35%, 40%, 45%, 50%, 55%, 60%, 65%, 70%, 75%, 80%, 85%, 90%, 95%, 96%, 97%, 98%, 99%, or greater than 99% relative to the subject prior to being administered the CFB RNAi agent or to a subject not receiving the CFB RNAi agent. The protein level in the subject may be reduced in a cell, group of cells, tissue, blood, and/or other fluid of the subject.

A reduction in CFB mRNA levels and CFB protein levels can be assessed by any methods known in the art. As used herein, a reduction or decrease in CFB mRNA level and/or protein level are collectively referred to herein as a reduction or decrease in CFB or inhibiting or reducing the gene expression of CFB. The Examples set forth herein illustrate known methods for assessing inhibition of CFB gene expression. The person of ordinary skill in the art would further know suitable methods for assessing inhibition of CFB gene expression in vivo and/or in vitro.

In some embodiments, the alternative pathway complement activity in a subject to whom a described CFB RNAi agent has been administered is reduced by at least about 30%, 35%, 40%, 45%, 50%, 55%, 60%, 65%, 70%, 75%, 80%, 85%, 90%, 95%, 96%, 97%, 98%, 99%, or greater than 99% relative to the subject prior to being administered the CFB RNAi agent or to a subject not receiving the CFB RNAi agent. The protein level in the subject may be reduced in a cell, group of cells, tissue, blood, and/or other fluid of the subject.

In some embodiments, disclosed herein are methods of treatment (including prophylactic or preventative treatment) of diseases, disorders, or symptoms associated with dysregulation of the complement system, including IgA nephropathy (IgAN), C3 glomerulopathy (C3G), immune complex-mediated membranoproliferative glomerulonephritis (IC-MPGN), lupus nephritis (LN), Anti-Glomerular Basement Membrane disease (anti-GBM), ischemia reperfusion injury and T-cell mediated rejection (TCMR) in kidney transplantation, anti-neutrophil cytoplasmic antibody (ANCA)-associated vasculitis, age-related macular degeneration (AMD), including early and/or intermediate AMD, geographic atrophy (GA), glaucoma, Doyne honeycomb retinal dystrophy, paroxysmal nocturnal hemoglobinuria (PNH), atypical hemolytic uremic syndrome (aHUS), pre-eclampsia, rheumatoid arthritis (RA), and/or other complement-mediated diseases (van Lookeren et al., 2016, Casiraghi et al., 2017, Wong & Kavanaugh 2018, Holers & Banda 2018, Poppelaars & Thurman 2020, Crowley et al., 2023, Blakey et al., 2023, Hoppe & Gregory-Ksander 2024), wherein the methods include administering to a subject in need thereof a therapeutically effective amount of a CFB RNAi agent that includes an antisense strand that is at least partially complementary to the portion of the CFB mRNA having the sequence in Table 1. In some embodiments, disclosed herein are methods of treatment (including prophylactic or preventative treatment) of diseases or symptoms associated with dysregulation of the complement system, including IgA nephropathy (IgAN), C3 glomerulopathy (C3G), immune complex-mediated membranoproliferative glomerulonephritis (IC-MPGN), lupus nephritis (LN), Anti-Glomerular Basement Membrane disease (anti-GBM), ischemia reperfusion injury and T-cell mediated rejection (TCMR) in kidney transplantation, anti-neutrophil cytoplasmic antibody (ANCA)-associated vasculitis, age-related macular degeneration (AMD), including early and/or intermediate AMD, geographic atrophy (GA), glaucoma, Doyne honeycomb retinal dystrophy, paroxysmal nocturnal hemoglobinuria (PNH), atypical hemolytic uremic syndrome (aHUS), pre-eclampsia, rheumatoid arthritis (RA), and/or other complement-mediated diseases (van Lookeren et al., 2016, Casiraghi et al., 2017, Wong & Kavanaugh 2018, Holers & Banda 2018, Poppelaars & Thurman 2020, Crowley et al., 2023, Blakey et al., 2023, Hoppe & Gregory-Ksander 2024), wherein the methods include administering to a subject in need thereof a therapeutically effective amount of a CFB RNAi agent that includes an antisense strand comprising the sequence of any of the sequences in Tables 2, 3, or 5C, and a sense strand that comprises any of the sequences in Tables 2, 4, or 5C that is at least partially complementary to the antisense strand. In some embodiments, disclosed herein are methods of treatment (including prophylactic or preventative treatment) of diseases or symptoms associated with dysregulation of the complement system, including IgA nephropathy (IgAN), C3 glomerulopathy (C3G), immune complex-mediated membranoproliferative glomerulonephritis (IC-MPGN), lupus nephritis (LN), Anti-Glomerular Basement Membrane disease (anti-GBM), ischemia reperfusion injury and T-cell mediated rejection (TCMR) in kidney transplantation, anti-neutrophil cytoplasmic antibody (ANCA)-associated vasculitis, age-related macular degeneration (AMD), including early and/or intermediate AMD, geographic atrophy (GA), glaucoma, Doyne honeycomb retinal dystrophy, paroxysmal nocturnal hemoglobinuria (PNH), atypical hemolytic uremic syndrome (aHUS), pre-eclampsia, rheumatoid arthritis (RA), and/or other complement-mediated diseases (van Lookeren et al., 2016, Casiraghi et al., 2017, Wong & Kavanaugh 2018, Holers & Banda 2018, Poppelaars & Thurman 2020, Crowley et al., 2023, Blakey et al., 2023, Hoppe & Gregory-Ksander 2024), wherein the methods include administering to a subject in need thereof a therapeutically effective amount of a CFB RNAi agent that includes a sense strand that comprises any of the sequences in Tables 2, 4A, 4B, or 5C and an antisense strand comprising the sequence of any of the sequences in Tables 2, 3, or 5C that is at least partially complementary to the sense strand.

In some embodiments, disclosed herein are methods for inhibiting expression of a CFB gene in a cell, wherein the methods include administering to the cell a CFB RNAi agent that includes an antisense strand that is at least partially complementary to the portion of the CFB mRNA having the sequence in Table 1. In some embodiments, disclosed herein are methods of inhibiting expression of a CFB gene in a cell, wherein the methods include administering to a cell a CFB RNAi agent that includes an antisense strand comprising the sequence of any of the sequences in Tables 2, 3, or 5C and a sense strand that comprises any of the sequences in Tables 2, 4A, 4B, or 5C that is at least partially complementary to the antisense strand. In some embodiments, disclosed herein are methods of inhibiting expression of a CFB gene in a cell, wherein the methods include administering a CFB RNAi agent that includes a sense strand that comprises any of the sequences in Tables 2, 4A, 4B, or 5C, and an antisense strand that includes the sequence of any of the sequences in Tables 2, 3, or 5C that is at least partially complementary to the sense strand.

The use of CFB RNAi agents provides methods for therapeutic (including prophylactic) treatment of diseases/disorders associated with dysregulation of the complement system, including IgA nephropathy (IgAN), C3 glomerulopathy (C3G), immune complex-mediated membranoproliferative glomerulonephritis (IC-MPGN), lupus nephritis (LN), Anti-Glomerular Basement Membrane disease (anti-GBM), ischemia reperfusion injury and T-cell mediated rejection (TCMR) in kidney transplantation, anti-neutrophil cytoplasmic antibody (ANCA)-associated vasculitis, age-related macular degeneration (AMD), including early and/or intermediate AMD, geographic atrophy (GA), glaucoma, Doyne honeycomb retinal dystrophy, paroxysmal nocturnal hemoglobinuria (PNH), atypical hemolytic uremic syndrome (aHUS), pre-eclampsia, rheumatoid arthritis (RA), and/or other complement-mediated diseases (van Lookeren et al., 2016, Casiraghi et al., 2017, Wong & Kavanaugh 2018, Holers & Banda 2018, Poppelaars & Thurman 2020, Crowley et al., 2023, Blakey et al., 2023, Hoppe & Gregory-Ksander 2024). The described CFB RNAi agents mediate RNA interference to inhibit the expression of one or more genes necessary for production of CFB protein. CFB RNAi agents can also be used to treat or prevent various diseases, disorders, or conditions, including IgA nephropathy (IgAN), C3 glomerulopathy (C3G), immune complex-mediated membranoproliferative glomerulonephritis (IC-MPGN), lupus nephritis (LN), Anti-Glomerular Basement Membrane disease (anti-GBM), ischemia reperfusion injury and T-cell mediated rejection (TCMR) in kidney transplantation, anti-neutrophil cytoplasmic antibody (ANCA)-associated vasculitis, age-related macular degeneration (AMD), including early and/or intermediate AMD, geographic atrophy (GA), glaucoma, Doyne honeycomb retinal dystrophy, paroxysmal nocturnal hemoglobinuria (PNH), atypical hemolytic uremic syndrome (aHUS), pre-eclampsia, rheumatoid arthritis (RA), and/or other complement-mediated diseases (van Lookeren et al., 2016, Casiraghi et al., 2017, Wong & Kavanaugh 2018, Holers & Banda 2018, Poppelaars & Thurman 2020, Crowley et al., 2023, Blakey et al., 2023, Hoppe & Gregory-Ksander 2024). Furthermore, compositions for delivery of CFB RNAi agents to liver cells, and specifically to hepatocytes, in vivo, are described.

Cells, Tissues, Organs, and Non-Human Organisms

Cells, tissues, organs, and non-human organisms that include at least one of the CFB RNAi agents described herein are contemplated. The cell, tissue, organ, or non-human organism is made by delivering the RNAi agent to the cell, tissue, organ or non-human organism.

The above provided embodiments and items are now illustrated with the following, non-limiting examples.

EXAMPLES

Example 1. Synthesis of CFB RNAi Agents

CFB RNAi agent duplexes shown in Tables 5A, 5B, and 5C, were synthesized in accordance with the following general procedures:

A. Synthesis.

The sense and antisense strands of the RNAi agents were synthesized according to phosphoramidite technology on solid phase used in oligonucleotide synthesis. Such standard synthesis is generally known in the art. Depending on the scale, either a MerMade96E® (Bioautomation), a MerMade12® (Bioautomation), or an OP Pilot 100 (GE Healthcare) was used. Syntheses were performed on a solid support made of controlled pore glass (CPG, 500 Å or 600 Å, obtained from Prime Synthesis, Aston, PA, USA). The monomer positioned at the 3' end of the respective strand was attached to the solid support as a starting point for synthesis. All RNA and 2'-modified RNA phosphoramidites were purchased from Thermo Fisher Scientific (Milwaukee, WI, USA) or Hongene Biotech (Shanghai, PRC). The 2'-O-methyl phosphoramidites included the following: (5'-O-dimethoxytrityl-$N^6$-(benzoyl)-2'-O-methyl-adenosine-3'-O-(2-cyanoethyl-N,N-diisopropylamino) phosphoramidite, 5'-O-dimethoxy-trityl-$N^4$-(acetyl)-2'-O-methyl-cytidine-3'-O-(2-cyanoethyl-N,N-diisopropyl-amino) phosphoramidite, (5'-O-dimethoxytrityl-$N^2$-(isobutyryl)-2'-O-methyl-guanosine-3'-O-(2-cyanoethyl-N,N-diisopropylamino) phosphoramidite, and 5'-O-dimethoxytrityl-2'-O-methyl-uridine-3'-O-(2-cyanoethyl-N,N-diisopropylamino) phosphoramidite. The 2'-deoxy-2'-fluoro-phosphoramidites carried the same protecting groups as the 2'-O-methyl amidites. 5'-(4,4'-Dimethoxytrityl)-2',3'-seco-uridine, 2'-benzoyl-3'-[(2-cyanoethyl)-(N,N-diisopropyl)]-phosphoramidite was also purchased from Thermo Fisher Scientific or Hongene Biotech. 5'-dimethoxytrityl-2'-O-methyl-inosine-3'-O-(2-cyanoethyl-N,N-diisopropylamino) phosphoramidites were purchased from Glen Research (Virginia) or Hongene Biotech. The cyclopropyl phosphonate phosphoramidites were synthesized in accordance with International Patent Application Publication No. WO 2017/214112 (see also Altenhofer et. al., Chem. Communications (Royal Soc. Chem.), 57(55): 6808-6811 (July 2021)). The inverted abasic (3'-O-dimethoxytrityl-2'-deoxyribose-5'-O-(2-cyanoethyl-N,N-diisopropylamino) phosphoramidites were purchased from ChemGenes (Wilmington, MA, USA) or SAFC (St Louis, MO, USA). 5'-O-dimethoxytrityl-$N^2$,$N^6$-(phenoxyacetate)-2'-O-methyl-diaminopurine-3'-O-(2-cyanoethyl-N,N-diisopropylamino) phosphoramidites were obtained from ChemGenes or Hongene Biotech.

Targeting ligand-containing phosphoramidites were dissolved in anhydrous dichloromethane or anhydrous acetonitrile (50 mM), while all other amidites were dissolved in anhydrous acetonitrile (50 mM), or anhydrous dimethylformamide and molecular sieves (3 Å) were added. 5-Benzyl-thio-1H-tetrazole (BTT, 250 mM in acetonitrile) or 5-Ethylthio-1H-tetrazole (ETT, 250 mM in acetonitrile) was used as activator solution. Coupling times were 12 min (RNA), 15 min (targeting ligand), 90 sec (2'OMe), and 60 sec (2'F). In order to introduce phosphorothioate linkages, a 100 mM solution of 3-phenyl 1,2,4-dithiazoline-5-one (POS, obtained from PolyOrg, Inc., Leominster, MA, USA) in anhydrous Acetonitrile was employed. Each of the CFB RNAi agent duplexes synthesized and tested in the following Examples utilized N-acetyl-galactosamine as "NAG" in the targeting ligand chemical structures represented in Table 6. (NAG37) and (NAG37)s targeting ligand phosphoramidite compounds can be synthesized generally in accordance with International Patent Application Publication No. WO 2018/044350 to Arrowhead Pharmaceuticals, Inc.

B. Cleavage and Deprotection of Support Bound Oligomer.

After finalization of the solid phase synthesis, the dried solid support was treated with a 1:1 volume solution of 40 wt. % methylarine in water and 28% ammonium hydroxide solution (Aldrich) for 1.5 hours at 30° C. The solution was evaporated and the solid residue was reconstituted in water (see below).

C. Purification.

Crude oligomers were purified by anionic exchange HPLC using a TSKgel SuperQ-5PW 13 µm column and Shimadzu LC-8 system. Buffer A was 20 mM Tris, 5 mM EDTA, pH 9.0 and contained 20% Acetonitrile and buffer B was the same as buffer A with the addition of 1.5 M sodium chloride. UV traces at 260 nm were recorded. Appropriate fractions were pooled then run on size exclusion HPLC using a GE Healthcare XK 26/40 column packed with Sephadex G-25 fine with a running buffer of filtered DI water or 100 mM ammonium bicarbonate, pH 6.7 and 20% Acetonitrile.

D. Annealing.

Complementary strands were mixed by combining equimolar RNA solutions (sense and antisense) in 1×Phosphate-Buffered Saline (Corning, Cellgro) to form the RNAi agents. Some RNAi agents were lyophilized and stored at −15 to −25° C. Duplex concentration was determined by measuring the solution absorbance on a UV-Vis spectrometer in 1×Phosphate-Buffered Saline. The solution absorbance at 260 nm was then multiplied by a conversion factor and the dilution factor to determine the duplex concentration. The conversion factor used was either 0.050 mg/(mL·cm) or was calculated from an experimentally determined extinction coefficient.

Example 2. hCFB-SEAP Mouse Model

To assess the potency of certain RNAi agents, a hCFB-SEAP mouse model was used. Six to eight week old female C57BL/6 albino mice were transiently transfected in vivo with plasmid, by hydrodynamic tail vein injection, administered at least 15 days prior to administration of a CFB RNAi agent or control. The plasmid contains the human CFB sequence (GenBank NM_001710.6 (SEQ ID NO: 1)) inserted into the 3' UTR of the SEAP (secreted human placental alkaline phosphatase) reporter gene. 10 µg to 50 µg of the plasmid containing the CFB gene sequence in Ringer's Solution in a total volume of 10% of the animal's body weight was injected into mice via the tail vein to create CFB-SEAP model mice. The solution was injected through a 27-gauge needle in 5-7 seconds as previously described (Zhang G et al., "High levels of foreign gene expression in hepatocytes after tail vein injection of naked plasmid DNA." Human Gene Therapy 1999 Vol. 10, p1735-1737.). Inhibition of expression of CFB sequences by a CFB RNAi agent results in concomitant inhibition of SEAP expression, which is measured by the Phospha-Light™ SEAP Reporter Gene Assay System (Invitrogen). Prior to treatment, SEAP expression levels in serum were measured and the mice were grouped according to average SEAP levels.

Analyses: SEAP levels may be measured at various times, both before and after administration of CFB RNAi agents.

i) Serum collection: Mice were anesthetized with 2-3% isoflurane and blood samples were collected from the sub-mandibular area into serum separation tubes (Sarstedt AG & Co., Nümbrecht, Germany). Blood was allowed to coagulate at ambient temperature for 20 min. The tubes were centrifuged at 8,000×g for 3 min to separate the serum and stored at 4° C.

ii) Serum SEAP levels: Serum was collected and measured by the Phospha-Light™ SEAP Reporter Gene Assay System (Invitrogen) according to the manufacturer's instructions. Serum SEAP levels for each animal was normalized to the control group of mice injected with saline in order to account for the non-treatment related decline in CFB sequence expression with this model. First, the SEAP level for each animal at a time point can be divided by the pre-treatment level of expression in that animal ("pre-treatment") in order to determine the ratio of expression "normalized to pre-treatment". Expression at a specific time point can be normalized to the control group by dividing the "normalized to pre-treatment" ratio for an individual animal by the average "normalized to pre-treatment" ratio of all mice in the normal saline control group. Alternatively, the serum SEAP levels for each animal can be assessed by normalizing to pre-treatment levels only.

Example 3. In Vivo Testing of CFB RNAi Agents in hCFB-SEAP Mice

The hCFB-SEAP mouse model described in Example 2, above, was used. At day 1, four (n=4) female C57bl/6 albino mice were given a single subcutaneous (SQ) injection of 200 µl per 20 g body weight containing either 3.0 mg/kg (mpk) of a CFB RNAi agent or saline without a CFB RNAi agent to be used as a control, according to the following Table 7.

TABLE 7

CFB RNAi agent and Dosing for Example 3

| Group ID | Dosing Regimen |
| --- | --- |
| Group 1 (isotonic saline) | Single SQ injection on day 1 |
| Group 2 (3.0 mg/kg AD12511) | Single SQ injection on day 1 |
| Group 3 (3.0 mg/kg AD12524) | Single SQ injection on day 1 |
| Group 4 (3.0 mg/kg AD12525) | Single SQ injection on day 1 |
| Group 5 (3.0 mg/kg AD12526) | Single SQ injection on day 1 |
| Group 6 (3.0 mg/kg AD12527) | Single SQ injection on day 1 |
| Group 7 (3.0 mg/kg AD12528) | Single SQ injection on day 1 |
| Group 8 (3.0 mg/kg AD12529) | Single SQ injection on day 1 |
| Group 9 (3.0 mg/kg AD12530) | Single SQ injection on day 1 |
| Group 10 (3.0 mg/kg AD12531) | Single SQ injection on day 1 |
| Group 11 (3.0 mg/kg AD12532) | Single SQ injection on day 1 |
| Group 12 (3.0 mg/kg AD12533) | Single SQ injection on day 1 |
| Group 13 (3.0 mg/kg AD12534) | Single SQ injection on day 1 |
| Group 14 (3.0 mg/kg AD12535) | Single SQ injection on day 1 |
| Group 15 (3.0 mg/kg AD12536) | Single SQ injection on day 1 |

Each of the CFB RNAi agents included N-acetyl-galactosamine targeting ligands ((NAG37)s) conjugated to the 5'-terminal end of the sense strand, as shown in Tables 5A, 5B, 5C, and 6, and were added as phosphoramidite compounds during the oligonucleotide synthesis process described above in Example 1.

The CFB RNAi agents in Groups 2-15 each included nucleotide sequences that were designed to inhibit expression of a CFB gene by targeting specific positions of CFB mRNA as set forth in Table 5B, above. (See, e.g., SEQ ID NO:1 and Table 2 for the CFB mRNA sequence referenced.) Specifically, Group 2 (AD12521) included nucleotide sequences designed to inhibition expression at position 992 of the CFB gene transcript; Group 3 (AD12524) included nucleotide sequences designed to inhibition expression at position 495 of the CFB gene transcript; Group 4 (AD12525) included nucleotide sequences designed to inhibition expression at position 778 of the CFB gene transcript; Group 5 (AD12526) included nucleotide sequences designed to inhibition expression at position 781 of the CFB gene transcript; Group 6 (AD12527) included nucleotide sequences designed to inhibition expression at position 784 of the CFB gene transcript; Group 7 (AD12528) included nucleotide sequences designed to inhibition expression at position 845 of the CFB gene transcript; Group 8 (AD12529) included nucleotide sequences designed to inhibition expression at position 927 of the CFB gene transcript; Group 9 (AD12530) included nucleotide sequences designed to inhibition expression at position 934 of the CFB gene transcript; Group 10 (AD12531) included nucleotide sequences designed to inhibition expression at position 954 of the CFB gene transcript; Group 11 (AD12532) included nucleotide sequences designed to inhibition expression at position 990 of the CFB gene transcript; Group 12 (AD12533) included nucleotide sequences designed to inhibition expression at position 1019 of the CFB gene transcript; Group 13 (AD12534) included nucleotide sequences designed to inhibition expression at position 1030 of the CFB gene transcript; Group 14 (AD12535) included nucleotide sequences designed to inhibition expression at position 1206 of the CFB gene transcript; and Group 15 (AD12536) included nucleotide sequences designed to inhibition expression at position 1315 of the CFB gene transcript. 12311 The injections were performed between the skin and muscle (i.e. subcutaneous injections) into the loose skin over the neck and shoulder area. Four (4) mice in each group were tested (n=4). Serum was collected on day 8, day 15, and day 22, and SEAP expression levels were determined pursuant to the procedure set forth in Example 2, above. Data from the experiment are shown in the following Table 8, with Average SEAP reflecting the normalized average value of SEAP.

TABLE 8

Average SEAP normalized to pre-treatment and saline control in CFB-SEAP mice from Example 3.

| | Day 8 | | Day 15 | |
|---|---|---|---|---|
| Group ID | Avg SEAP | Std Dev (+/−) | Avg SEAP | Std Dev (+/−) |
| Group 1 (isotonic saline) | 1.000 | 0.101 | 1.000 | 0.155 |
| Group 2 (3.0 mg/kg AD12511) | 0.823 | 0.244 | 0.952 | 0.333 |
| Group 3 (3.0 mg/kg AD12524) | 0.778 | 0.150 | 0.845 | 0.156 |
| Group 4 (3.0 mg/kg AD12525) | 1.013 | 0.206 | 1.098 | 0.105 |
| Group 5 (3.0 mg/kg AD12526) | 0.847 | 0.131 | 0.740 | 0.228 |
| Group 6 (3.0 mg/kg AD12527) | 1.117 | 0.406 | 0.679 | 0.215 |
| Group 7 (3.0 mg/kg AD12528) | 0.868 | 0.312 | 1.260 | 0.360 |
| Group 8 (3.0 mg/kg AD12529) | 0.589 | 0.283 | 0.896 | 0.186 |
| Group 9 (3.0 mg/kg AD12530) | 1.023 | 0.137 | 1.428 | 0.242 |
| Group 10 (3.0 mg/kg AD12531) | 0.894 | 0.159 | 0.881 | 0.103 |
| Group 11 (3.0 mg/kg AD12532) | 0.895 | 0.205 | 0.616 | 0.163 |
| Group 12 (3.0 mg/kg AD12533) | 1.072 | 0.081 | 1.169 | 0.103 |
| Group 13 (3.0 mg/kg AD12534) | 0.936 | 0.146 | 1.153 | 0.204 |
| Group 14 (3.0 mg/kg AD12535) | 0.885 | 0.057 | 1.059 | 0.105 |
| Group 15 (3.0 mg/kg AD12536) | 0.778 | 0.150 | 0.632 | 0.088 |

| | Day 22 | |
|---|---|---|
| Group ID | Avg SEAP | Std Dev (+/−) |
| Group 1 (isotonic saline) | 1.000 | 0.155 |
| Group 2 (3.0 mg/kg AD12511) | 0.853 | 0.376 |
| Group 3 (3.0 mg/kg AD12524) | 1.191 | 0.251 |
| Group 4 (3.0 mg/kg AD12525) | 0.758 | 0.140 |
| Group 5 (3.0 mg/kg AD12526) | 0.960 | 0.405 |
| Group 6 (3.0 mg/kg AD12527) | 0.656 | 0.290 |
| Group 7 (3.0 mg/kg AD12528) | 1.056 | 0.375 |
| Group 8 (3.0 mg/kg AD12529) | 0.713 | 0.275 |
| Group 9 (3.0 mg/kg AD12530) | 1.044 | 0.108 |
| Group 10 (3.0 mg/kg AD12531) | 0.829 | 0.184 |
| Group 11 (3.0 mg/kg AD12532) | 0.486 | 0.155 |
| Group 12 (3.0 mg/kg AD12533) | 1.097 | 0.154 |
| Group 13 (3.0 mg/kg AD12534) | 1.003 | 0.209 |
| Group 14 (3.0 mg/kg AD12535) | 0.860 | 0.201 |
| Group 15 (3.0 mg/kg AD12536) | 0.526 | 0.110 |

As shown above, several of the Groups of CFB RNAi agents tested showed little to no inhibition. On Day 8, Group 8 (AD12529, targeting position 927 of the CFB gene) showed the greatest reduction in SEAP compared to the saline control (Group 1) with approximately a 41% reduction (0.589). On Day 22, Group 11 (AD12532, targeting position 990 of the CFB gene) and Group 15 (AD12536, targeting position 1315 of the CFB gene) showed reductions of approximately 51% (0.486) and 43% (0.526), respectively, in this hCFB-SEAP mouse model.

Example 4. In Vivo Testing of CFB RNAi Agents in hCFB-SEAP Mice

The hCFB-SEAP mouse model described in Example 2, above, was used. At day 1, four (n=4) female C57bl/6 albino mice were given a single subcutaneous (SQ) injection of 200 µl per 20 g body weight containing either 3.0 mg/kg (mpk) of a CFB RNAi agent or saline without a CFB RNAi agent to be used as a control, according to the following Table 9.

TABLE 9

CFB RNAi agent and Dosing for Example 3

| Group ID | Dosing Regimen |
|---|---|
| Group 1 (isotonic saline) | Single SQ injection on day 1 |
| Group 2 (3.0 mg/kg AD12536) | Single SQ injection on day 1 |
| Group 3 (3.0 mg/kg AD13946) | Single SQ injection on day 1 |
| Group 4 (3.0 mg/kg AD13947) | Single SQ injection on day 1 |
| Group 5 (3.0 mg/kg AD13948) | Single SQ injection on day 1 |
| Group 6 (3.0 mg/kg AD13949) | Single SQ injection on day 1 |
| Group 7 (3.0 mg/kg AD13950) | Single SQ injection on day 1 |
| Group 8 (3.0 mg/kg AD13953) | Single SQ injection on day 1 |
| Group 9 (3.0 mg/kg AD13954) | Single SQ injection on day 1 |
| Group 10 (3.0 mg/kg AD13955) | Single SQ injection on day 1 |
| Group 11 (3.0 mg/kg AD13956) | Single SQ injection on day 1 |
| Group 12 (3.0 mg/kg AD13957) | Single SQ injection on day 1 |
| Group 13 (3.0 mg/kg AD13958) | Single SQ injection on day 1 |

Each of the CFB RNAi agents included N-acetyl-galactosamine targeting ligands ((NAG37)s) conjugated to the 5'-terminal end of the sense strand, as shown in Tables 5A, 5B, 5C, and 6, and were added as phosphoramidite compounds during the oligonucleotide synthesis process described above in Example 1.

Each of the CFB RNAi agents in Groups 2-13 included nucleotide sequences that were designed to inhibit expression of a CFB gene by targeting position 1315 of the CFB mRNA as set forth in Table 5B, above, but have different chemical modifications applied. (See, e.g., SEQ ID NO:1 and Table 2 for the CFB mRNA sequence referenced.).

The injections were performed between the skin and muscle (i.e. subcutaneous injections) into the loose skin over the neck and shoulder area. Four (4) mice in each group were tested (n=4). Serum was collected on day 8 and day 15, and SEAP expression levels were determined pursuant to the procedure set forth in Example 2, above. Data from the experiment are shown in the following Table 10, with Average SEAP reflecting the normalized average value of SEAP.

TABLE 10

Average SEAP normalized to pre-treatment and saline control in CFB-SEAP mice from Example 3.

| Group ID | Day 8 | | Day 15 | |
| --- | --- | --- | --- | --- |
| | Avg SEAP | Std Dev (+/−) | Avg SEAP | Std Dev (+/−) |
| Group 1 (isotonic saline) | 1.000 | 0.176 | 1.000 | 0.378 |
| Group 2 (3.0 mg/kg AD12536) | 0.432 | 0.117 | 0.531 | 0.078 |
| Group 3 (3.0 mg/kg AD13946) | 0.557 | 0.107 | 0.421 | 0.066 |
| Group 4 (3.0 mg/kg AD13947) | 0.458 | 0.074 | 0.540 | 0.083 |
| Group 5 (3.0 mg/kg AD13948) | 0.677 | 0.097 | 0.804 | 0.426 |
| Group 6 (3.0 mg/kg AD13949) | 0.600 | 0.038 | 0.548 | 0.217 |
| Group 7 (3.0 mg/kg AD13950) | 0.623 | 0.103 | 0.588 | 0.157 |
| Group 8 (3.0 mg/kg AD13953) | 0.622 | 0.081 | 0.655 | 0.066 |
| Group 9 (3.0 mg/kg AD13954) | 0.574 | 0.093 | 0.462 | 0.100 |
| Group 10 (3.0 mg/kg AD13955) | 0.562 | 0.075 | 0.468 | 0.112 |
| Group 11 (3.0 mg/kg AD13956) | 0.495 | 0.062 | 0.645 | 0.409 |
| Group 12 (3.0 mg/kg AD13957) | 0.560 | 0.076 | 0.511 | 0.109 |
| Group 13 (3.0 mg/kg AD13958) | 0.506 | 0.060 | 0.539 | 0.127 |

As shown above, each of the CFB RNAi agents tested were active having approximately 30% to approximately 58% silencing activity in the hCFB-SEAP mouse model.

Example 5. In Vivo Testing of CFB RNAi Agents in Wild-Type Mice

Certain CFB RNAi agents have sufficient homology with the mouse CFB gene transcript that they are suitable to be examined for CFB gene expression inhibitory activity in wild-type mice. At day 1, six- to eight-week-old male C57bl/6 mice were given a single subcutaneous administration of 200 μl/20 g animal weight containing 2.0 mg/kg (mpk) of a CFB RNAi agent formulated in isotonic saline, or vehicle control (isotonic saline with no RNAi agent), according to the following Table 11.

TABLE 11

Targeted Positions and Dosing Groups of Example 5

| Group | Targeted Gene Position (within SEQ ID NO: 1) | RNAi Agent and Dose | Dosing Regimen |
| --- | --- | --- | --- |
| 1 | N/A | Saline (no RNAi agent) | Single SQ injection on day 1 |
| 2 | 936 | 2.0 mg/kg AD12080 | Single SQ injection on day 1 |
| 3 | 937 | 2.0 mg/kg AD12081 | Single SQ injection on day 1 |
| 4 | 938 | 2.0 mg/kg AD12082 | Single SQ injection on day 1 |
| 5 | 939 | 2.0 mg/kg AD12083 | Single SQ injection on day 1 |
| 6 | 941 | 2.0 mg/kg AD12084 | Single SQ injection on day 1 |
| 7 | 945 | 2.0 mg/kg AD12085 | Single SQ injection on day 1 |
| 8 | 949 | 2.0 mg/kg AD12086 | Single SQ injection on day 1 |
| 9 | 1547 | 2.0 mg/kg AD12087 | Single SQ injection on day 1 |
| 10 | 1667 | 2.0 mg/kg AD12088 | Single SQ injection on day 1 |
| 11 | 2255 | 2.0 mg/kg AD12089 | Single SQ injection on day 1 |
| 12 | 2394 | 2.0 mg/kg AD12094 | Single SQ injection on day 1 |
| 13 | 2395 | 2.0 mg/kg AD12095 | Single SQ injection on day 1 |
| 14 | 2399 | 2.0 mg/kg AD12099 | Single SQ injection on day 1 |

Each of the CFB RNAi agents included modified nucleotides that were conjugated at the 5' terminal end of the sense strand to a targeting ligand that included three N-acetylgalactosamine groups (tridentate ligand) having the modified sequences as set forth in the duplex structures herein. (See Tables 3, 4, 5A, 5B, 5C, and 6 for specific modifications and structure information related to the CFB RNAi agents, including (NAG37)s ligand). The CFB RNAi agents in Groups 2-14 each included nucleotide sequences that, while also being homologous to the mouse CFB gene transcript, were designed to inhibit expression of a human CFB gene at specific positions as noted in the Table 11 above. (See also, SEQ ID NO:1 and Table 2 for the CFB gene referenced).

The injections were performed between the skin and muscle (i.e. subcutaneous injections) into the loose skin over the neck and shoulder area. Four (4) mice in each group were tested (n=4). Mice were euthanized on study day 8, and total RNA was isolated from both livers and both eyes following collection and homogenization. Mouse CFB mRNA expression was quantitated by probe-based quantitative PCR, normalized to mouse beta-actin expression, and expressed as fraction of vehicle control group (geometric mean, +/−95% confidence interval).

TABLE 12

Average Relative Mouse CFB mRNA at Sacrifice (Day 8) in Example 5 in Mouse Liver

| Group ID | Average Relative mCFB mRNA | Low (error) | High (error) |
| --- | --- | --- | --- |
| Group 1 (isotonic saline) | 1.000 | 0.102 | 0.113 |
| Group 2 (2.0 mg/kg AD12080) | 1.297 | 0.160 | 0.182 |
| Group 3 (2.0 mg/kg AD12081) | 0.870 | 0.103 | 0.116 |
| Group 4 (2.0 mg/kg AD12082) | 1.064 | 0.071 | 0.076 |
| Group 5 (2.0 mg/kg AD12083) | 1.069 | 0.099 | 0.109 |
| Group 6 (2.0 mg/kg AD12084) | 0.707 | 0.097 | 0.113 |
| Group 7 (2.0 mg/kg AD12085) | 0.681 | 0.041 | 0.044 |
| Group 8 (2.0 mg/kg AD12086) | 0.632 | 0.107 | 0.129 |
| Group 9 (2.0 mg/kg AD12087) | 0.355 | 0.010 | 0.010 |
| Group 10 (2.0 mg/kg AD12088) | 0.305 | 0.027 | 0.030 |
| Group 11 (2.0 mg/kg AD12089) | 0.812 | 0.100 | 0.114 |
| Group 12 (2.0 mg/kg AD12094) | 0.434 | 0.066 | 0.077 |
| Group 13 (2.0 mg/kg AD12095) | 0.698 | 0.119 | 0.143 |
| Group 14 (2.0 mg/kg AD12096) | 0.213 | 0.021 | 0.023 |

The data were normalized to the isotonic saline-treated group (Group 1). As shown in Tables 12 above, each of the CFB RNAi agents (Groups 2-14) showed mCFB mRNA reductions in the liver. In particular Group 10 (AD12088, targeting position 1667 of the CFB gene) and Group 14

(AD12096, targeting position 2399 of the CFB gene) showed particularly robust inhibition of mCFB mRNA at day 8, with both achieving approximately 70% or greater silencing activity in the liver (~70% (0.305) and ~79% (0.213), respectively) and the eye (~73% (0.268) and ~77% (0.227), respectively).

To confirm consistency of the knockdown data, liver samples were re-analyzed for certain of the CFB RNAi agents tested, as shown in the following Table 14:

TABLE 14

Average Relative Mouse CFB mRNA at Sacrifice (Day 8) in Example 5 in Mouse Liver (Run 2)

| Group ID | Average Relative mCFB mRNA | Low (error) | High (error) |
|---|---|---|---|
| Group 1 (isotonic saline) | 1.000 | 0.051 | 0.053 |
| Group 4 (2.0 mg/kg AD12082) | 1.041 | 0.077 | 0.084 |
| Group 8 (2.0 mg/kg AD12086) | 0.685 | 0.101 | 0.118 |
| Group 10 (2.0 mg/kg AD12088) | 0.341 | 0.041 | 0.046 |
| Group 14 (2.0 mg/kg AD12096) | 0.242 | 0.018 | 0.019 |

The data in Table 14 were consistent with the data in Table 12, with the CFB RNAi agents of Group 10 (AD12088, targeting position 1667 of the CFB gene) and Group 14 (AD012096, targeting position 2399 of the CFB gene) showing particularly robust inhibitory activity of CFB gene expression, while the RNAi agent of Group 4 (AD12082, targeting position 938 of the CFB gene) showing no inhibition compared to saline control.

Example 6. In Vivo Testing of CFB RNAi Agents in Wild-Type Mice

At day 1, six- to eight-week-old male C57bl/6 mice were given a single subcutaneous administration of 200 μl/20 g animal weight containing 1.0 mg/kg (mpk) of a CFB RNAi agent formulated in isotonic saline, or vehicle control (isotonic saline with no RNAi agent), according to the following Table 15.

TABLE 15

Targeted Positions and Dosing Groups of Example 6

| Group | Targeted Gene Position (within SEQ ID NO: 1) | RNAi Agent and Dose | Dosing Regimen |
|---|---|---|---|
| 1 | N/A | Saline (no RNAi agent) | Single SQ injection on day 1 |
| 2 | 2399 | 1.0 mg/kg AD12096 | Single SQ injection on day 1 |
| 3 | 2399 | 1.0 mg/kg AD12495 | Single SQ injection on day 1 |
| 4 | 2399 | 1.0 mg/kg AD12496 | Single SQ injection on day 1 |
| 5 | 2399 | 1.0 mg/kg AD12497 | Single SQ injection on day 1 |
| 6 | 2399 | 1.0 mg/kg AD12498 | Single SQ injection on day 1 |
| 7 | 2399 | 1.0 mg/kg AD12499 | Single SQ injection on day 1 |
| 8 | 2399 | 1.0 mg/kg AD12500 | Single SQ injection on day 1 |
| 9 | 2399 | 1.0 mg/kg AD12501 | Single SQ injection on day 1 |
| 10 | 2399 | 1.0 mg/kg AD12502 | Single SQ injection on day 1 |
| 11 | 2399 | 1.0 mg/kg AD12503 | Single SQ injection on day 1 |
| 12 | 2399 | 1.0 mg/kg AD12504 | Single SQ injection on day 1 |
| 13 | 2399 | 1.0 mg/kg AD12505 | Single SQ injection on day 1 |
| 14 | 2399 | 1.0 mg/kg AD12506 | Single SQ injection on day 1 |
| 15 | 2399 | 1.0 mg/kg AD12507 | Single SQ injection on day 1 |
| 16 | 2399 | 1.0 mg/kg AD12508 | Single SQ injection on day 1 |
| 17 | 2399 | 1.0 mg/kg AD12509 | Single SQ injection on day 1 |

Each of the CFB RNAi agents included modified nucleotides that were conjugated at the 5' terminal end of the sense strand to a targeting ligand that included three N-acetylgalactosamine groups (tridentate ligand) having the modified sequences as set forth in the duplex structures herein. (See Tables 3, 4, 5A, 5B, 5C, and 6 for specific modifications and structure information related to the CFB RNAi agents, including (NAG37)s ligand). The CFB RNAi agents in Groups 2-17 each included nucleotide sequences that, while also being homologous to the mouse CFB gene transcript, were designed to inhibit expression of a human CFB gene at position 2399 of the CFB gene as noted in the Table 15 above, but had different chemical modifications. (See also, SEQ ID NO:1 and Table 2 for the CFB gene referenced).

The injections were performed between the skin and muscle (i.e. subcutaneous injections) into the loose skin over the neck and shoulder area. Four (4) mice in each group were tested (n=4). Mice were euthanized on study day 15, and total RNA was isolated from both livers following collection and homogenization. Mouse CFB mRNA expression was quantitated by probe-based quantitative PCR, normalized to mouse beta-actin expression, and expressed as fraction of vehicle control group (geometric mean, +/−95% confidence interval).

TABLE 16

Average Relative Mouse CFB mRNA at Sacrifice (Day 15) in Example 6 in Mouse Liver

| Group ID | Average Relative mCFB mRNA | Low (error) | High (error) |
|---|---|---|---|
| Group 1 (isotonic saline) | 1.000 | 0.152 | 0.180 |
| Group 2 (1.0 mg/kg AD12096) | 0.404 | 0.072 | 0.087 |
| Group 3 (1.0 mg/kg AD12495) | 0.400 | 0.038 | 0.042 |
| Group 4 (1.0 mg/kg AD12496) | 0.253 | 0.062 | 0.082 |
| Group 5 (1.0 mg/kg AD12497) | 0.420 | 0.025 | 0.027 |
| Group 6 (1.0 mg/kg AD12498) | 0.285 | 0.054 | 0.066 |
| Group 7 (1.0 mg/kg AD12499) | 0.410 | 0.031 | 0.033 |
| Group 8 (1.0 mg/kg AD12500) | 0.371 | 0.124 | 0.186 |
| Group 9 (1.0 mg/kg AD12501) | 0.472 | 0.039 | 0.042 |
| Group 10 (1.0 mg/kg AD12502) | 0.268 | 0.097 | 0.153 |
| Group 11 (1.0 mg/kg AD12503) | 0.506 | 0.034 | 0.036 |
| Group 12 (1.0 mg/kg AD12504) | 0.320 | 0.095 | 0.135 |
| Group 13 (1.0 mg/kg AD12505) | 0.260 | 0.037 | 0.043 |
| Group 14 (1.0 mg/kg AD12506) | 0.243 | 0.025 | 0.028 |
| Group 15 (1.0 mg/kg AD12507) | 0.285 | 0.009 | 0.009 |
| Group 16 (1.0 mg/kg AD12508) | 0.274 | 0.030 | 0.034 |
| Group 17 (1.0 mg/kg AD12509) | 0.257 | 0.037 | 0.044 |

The data were normalized to the saline treated group (Group 1). As shown in Table 16, above, each of the CFB RNAi agents (Groups 2-17), which all targeted position 2399 of the CFB gene, showed substantial mCFB mRNA reductions in the liver, with all CFB RNAi agents showing ~50% knockdown or greater, with the most potent CFB RNAi agents showing ~75 knockdown of mCFB mRNA on day 15.

Example 7. In Vivo Testing of CFB RNAi Agents in Wild-Type Mice

At day 1, six- to eight-week-old male C57bl/6 mice were given a single subcutaneous administration of 200 μl/20 g animal weight containing 1.0 mg/kg (mpk) of a CFB RNAi agent formulated in isotonic saline, or vehicle control (isotonic saline with no RNAi agent), according to the following Table 17.

TABLE 17

Targeted Positions and Dosing Groups of Example 7

| Group | Targeted Gene Position (within SEQ ID NO: 1) | RNAi Agent and Dose | Dosing Regimen |
|---|---|---|---|
| 1 | N/A | Saline (no RNAi agent) | Single SQ injection on day 1 |
| 2 | 1667 | 1.0 mg/kg AD12088 | Single SQ injection on day 1 |
| 3 | 1667 | 1.0 mg/kg AD12550 | Single SQ injection on day 1 |
| 4 | 1667 | 1.0 mg/kg AD12551 | Single SQ injection on day 1 |
| 5 | 1667 | 1.0 mg/kg AD12552 | Single SQ injection on day 1 |
| 6 | 1667 | 1.0 mg/kg AD12553 | Single SQ injection on day 1 |
| 7 | 1667 | 1.0 mg/kg AD12554 | Single SQ injection on day 1 |
| 8 | 1667 | 1.0 mg/kg AD12555 | Single SQ injection on day 1 |
| 9 | 1667 | 1.0 mg/kg AD12556 | Single SQ injection on day 1 |
| 10 | 1667 | 1.0 mg/kg AD12557 | Single SQ injection on day 1 |
| 11 | 1667 | 1.0 mg/kg AD12558 | Single SQ injection on day 1 |
| 12 | 1667 | 1.0 mg/kg AD12559 | Single SQ injection on day 1 |
| 13 | 1667 | 1.0 mg/kg AD12560 | Single SQ injection on day 1 |
| 14 | 1667 | 1.0 mg/kg AD12561 | Single SQ injection on day 1 |
| 15 | 1667 | 1.0 mg/kg AD12562 | Single SQ injection on day 1 |
| 16 | 1667 | 1.0 mg/kg AD12563 | Single SQ injection on day 1 |
| 17 | 1667 | 1.0 mg/kg AD12564 | Single SQ injection on day 1 |

Each of the CFB RNAi agents included modified nucleotides that were conjugated at the 5' terminal end of the sense strand to a targeting ligand that included three N-acetylgalactosamine groups (tridentate ligand) having the modified sequences as set forth in the duplex structures herein. (See Tables 3, 4, 5A, 5B, 5C, and 6 for specific modifications and structure information related to the CFB RNAi agents, including (NAG37)s ligand). The CFB RNAi agents in Groups 2-17 each included nucleotide sequences that, while also being homologous to the mouse CFB gene transcript, were designed to inhibit expression of a human CFB gene at position 1667 of the CFB gene as noted in the Table 17 above, but had different chemical modifications. (See also, SEQ ID NO:1 and Table 2 for the CFB gene referenced).

The injections were performed between the skin and muscle (i.e. subcutaneous injections) into the loose skin over the neck and shoulder area. Four (4) mice in each group were tested (n=4), except for Group 8 (AD12555) and Group 15 (AD12562) where only three mice (n=3) were tested. Mice were euthanized on study day 15, and total RNA was isolated from both livers following collection and homogenization. Mouse CFB mRNA expression was quantitated by probe-based quantitative PCR, normalized to mouse beta-actin expression, and expressed as fraction of vehicle control group (geometric mean, +/−95% confidence interval).

TABLE 18

Average Relative Mouse CFB mRNA at Sacrifice (Day 15) in Example 7 in Mouse Liver

| Group ID | Average Relative mCFB mRNA | Low (error) | High (error) |
|---|---|---|---|
| Group 1 (isotonic saline)) | 1.000 | 0.220 | 0.282 |
| Group 2 (1.0 mg/kg AD12088) | 0.404 | 0.335 | 0.602 |
| Group 3 (1.0 mg/kg AD12550) | 0.358 | 0.049 | 0.055 |
| Group 4 (1.0 mg/kg AD12551) | 0.274 | 0.057 | 0.071 |
| Group 5 (1.0 mg/kg AD12552) | 0.206 | 0.128 | 0.211 |
| Group 6 (1.0 mg/kg AD12553) | 0.350 | 0.081 | 0.111 |
| Group 7 (1.0 mg/kg AD12554) | 0.341 | 0.215 | 0.378 |
| Group 8 (1.0 mg/kg AD12555) | 0.415 | 0.114 | 0.153 |
| Group 9 (1.0 mg/kg AD12556) | 0.597 | 0.055 | 0.062 |
| Group 10 (1.0 mg/kg AD12557) | 1.881 | 0.207 | 0.373 |
| Group 11 (1.0 mg/kg AD12558) | 0.626 | 0.034 | 0.039 |
| Group 12 (1.0 mg/kg AD12559) | 0.266 | 0.017 | 0.020 |
| Group 13 (1.0 mg/kg AD12560) | 0.1408 | 0.046 | 0.068 |
| Group 14 (1.0 mg/kg AD12561) | 0.395 | 0.028 | 0.033 |
| Group 15 (1.0 mg/kg AD12562) | 0.577 | 0.048 | 0.063 |
| Group 16 (1.0 mg/kg AD12563) | 0.2394 | 0.030 | 0.035 |
| Group 17 (1.0 mg/kg AD12564) | 0.315 | 0.026 | 0.032 |

The data were normalized to the saline treated group (Group 1). As shown in Table 18, above, each of the CFB RNAi agents other than Group 2 (AD12088), which all targeted position 1667 of the CFB gene, showed substantial mCFB mRNA reductions in the liver, except group 10, with all CFB RNAi agents in Groups 3-17 showing ~50% knockdown or greater, with the most potent CFB RNAi agents showing knockdown approaching 80% of mCFB mRNA on day 15 (See, e.g., Group 4 (AD12551, showing ~0.72% knockdown (0.274)), Group 5 (AD12552, showing ~80% knockdown (0.206)); Group 12 (AD12559, showing ~73% knockdown (0.266)), etc.).

Example 8. In Vivo Testing of CFB RNAi Agents in Wild-Type Mice

At day 1, six- to eight-week-old male C57bl/6 mice were given a single subcutaneous administration of 200 μl/20 g animal weight containing 0.5 mg/kg (mpk) of a CFB RNAi agent formulated in isotonic saline, or vehicle control (isotonic saline with no RNAi agent), according to the following Table 19.

TABLE 19

Targeted Positions and Dosing Groups of Example 8

| Group | Targeted Gene Position (within SEQ ID NO: 1) | RNAi Agent and Dose | Dosing Regimen |
|---|---|---|---|
| 1 | N/A | Saline (no RNAi agent) | Single SQ injection on day 1 |
| 2 | 2399 | 0.5 mg/kg AD12496 | Single SQ injection on day 1 |
| 3 | 2399 | 0.5 mg/kg AD12502 | Single SQ injection on day 1 |
| 4 | 2399 | 0.5 mg/kg AD12505 | Single SQ injection on day 1 |
| 5 | 2399 | 0.5 mg/kg AD12506 | Single SQ injection on day 1 |
| 6 | 2399 | 0.5 mg/kg AD12508 | Single SQ injection on day 1 |
| 7 | 2399 | 0.5 mg/kg AD12964 | Single SQ injection on day 1 |
| 8 | 2399 | 0.5 mg/kg AD12965 | Single SQ injection on day 1 |
| 9 | 2399 | 0.5 mg/kg AD12966 | Single SQ injection on day 1 |
| 10 | 2399 | 0.5 mg/kg AD12967 | Single SQ injection on day 1 |
| 11 | 2399 | 0.5 mg/kg AD12968 | Single SQ injection on day 1 |
| 12 | 2399 | 0.5 mg/kg AD12969 | Single SQ injection on day 1 |
| 13 | 2399 | 0.5 mg/kg AD12970 | Single SQ injection on day 1 |
| 14 | 2399 | 0.5 mg/kg AD12971 | Single SQ injection on day 1 |
| 15 | 2399 | 0.5 mg/kg AD12096 | Single SQ injection on day 1 |

Each of the CFB RNAi agents included modified nucleotides that were conjugated at the 5' terminal end of the sense strand to a targeting ligand that included three N-acetylgalactosamine groups (tridentate ligand) having the modified sequences as set forth in the duplex structures herein. (See Tables 3, 4, 5A, 5B, 5C, and 6 for specific modifications and structure information related to the CFB RNAi agents, including (NAG37)s ligand). The CFB RNAi agents in Groups 2-15 each included nucleotide sequences that, while also being homologous to the mouse CFB gene transcript, were designed to inhibit expression of a human CFB gene at position 2399 of the CFB gene as noted in the Table 19 above, but had different chemical modifications. (See also, SEQ ID NO:1 and Table 2 for the CFB gene referenced).

The injections were performed between the skin and muscle (i.e. subcutaneous injections) into the loose skin over the neck and shoulder area. Four (4) mice in each group were tested (n=4). Mice were euthanized on study day 15, and total RNA was isolated from both livers following collection and homogenization. Mouse CFB mRNA expression was quantitated by probe-based quantitative PCR, normalized to mouse beta-actin expression, and expressed as fraction of vehicle control group (geometric mean, +/−95 confidence interval).

TABLE 20

Average Relative Mouse CFB mRNA at Sacrifice (Day 15) in Example 8 in Mouse Liver

| Group ID | Average Relative mCFB mRNA | Low (error) | High (error) |
|---|---|---|---|
| Group 1 (isotonic saline)) | 1.000 | 0.148 | 0.174 |
| Group 2 (0.5 mg/kg AD12496) | 0.453 | 0.050 | 0.056 |
| Group 3 (0.5 mg/kg AD12502) | 0.539 | 0.091 | 0.110 |
| Group 4 (0.5 mg/kg AD12505) | 0.540 | 0.057 | 0.063 |
| Group 5 (0.5 mg/kg AD12506) | 0.487 | 0.043 | 0.047 |
| Group 6 (0.5 mg/kg AD12508) | 0.507 | 0.084 | 0.100 |
| Group 7 (0.5 mg/kg AD12964) | 0.387 | 0.044 | 0.049 |
| Group 8 (0.5 mg/kg AD12965) | 0.596 | 0.054 | 0.059 |
| Group 9 (0.5 mg/kg AD12966) | 0.445 | 0.032 | 0.035 |
| Group 10 (0.5 mg/kg AD12967) | 0.684 | 0.083 | 0.094 |
| Group 11 (0.5 mg/kg AD12968) | 0.436 | 0.043 | 0.048 |
| Group 12 (0.5 mg/kg AD12969) | 0.692 | 0.131 | 0.162 |
| Group 13 (0.5 mg/kg AD12970) | 0.551 | 0.054 | 0.059 |
| Group 14 (0.5 mg/kg AD12971) | 0.762 | 0.074 | 0.082 |
| Group 15 (0.5 mg/kg AD12096) | 0.688 | 0.174 | 0.233 |

The data were normalized to the saline treated group (Group 1). As shown in Table 20, above, each of the CFB RNAi agents, which all targeted position 2399 of the CFB gene, showed mCFB mRNA reductions in the liver.

Example 9. In Vivo Testing of CFB RNAi Agents in Wild-Type Mice

At day 1, six- to eight-week-old male C57bl/6 mice were given a single subcutaneous administration of 200 μl/20 g animal weight containing 0.5 mg/kg (mpk) of a CFB RNAi agent formulated in isotonic saline, or vehicle control (isotonic saline with no RNAi agent), according to the following Table 21.

TABLE 21

Targeted Positions and Dosing Groups of Example 9

| Group | Targeted Gene Position (within SEQ ID NO: 1) | RNAi Agent and Dose | Dosing Regimen |
|---|---|---|---|
| 1 | N/A | Saline (no RNAi agent) | Single SQ injection on day 1 |
| 2 | 1667 | 0.5 mg/kg AD12088 | Single SQ injection on day 1 |
| 3 | 1667 | 0.5 mg/kg AD12552 | Single SQ injection on day 1 |
| 4 | 1667 | 0.5 mg/kg AD12559 | Single SQ injection on day 1 |
| 5 | 1667 | 0.5 mg/kg AD12563 | Single SQ injection on day 1 |
| 6 | 1667 | 0.5 mg/kg AD13123 | Single SQ injection on day 1 |
| 7 | 1667 | 0.5 mg/kg AD13124 | Single SQ injection on day 1 |
| 8 | 1667 | 0.5 mg/kg AD13125 | Single SQ injection on day 1 |
| 9 | 1667 | 0.5 mg/kg AD13126 | Single SQ injection on day 1 |
| 10 | 1667 | 0.5 mg/kg AD13127 | Single SQ injection on day 1 |
| 11 | 1667 | 0.5 mg/kg AD13128 | Single SQ injection on day 1 |
| 12 | 1667 | 0.5 mg/kg AD13036 | Single SQ injection on day 1 |
| 13 | 1667 | 0.5 mg/kg AD13037 | Single SQ injection on day 1 |
| 14 | 1667 | 0.5 mg/kg AD13038 | Single SQ injection on day 1 |
| 15 | 1667 | 0.5 mg/kg AD13039 | Single SQ injection on day 1 |
| 16 | 1667 | 0.5 mg/kg AD13040 | Single SQ injection on day 1 |
| 17 | 1667 | 0.5 mg/kg AD13041 | Single SQ injection on day 1 |

Each of the CFB RNAi agents included modified nucleotides that were conjugated at the 5' terminal end of the sense strand to a targeting ligand that included three N-acetylgalactosamine groups (tridentate ligand) having the modified sequences as set forth in the duplex structures herein. (See Tables 3, 4, 5A, 5B, 5C, and 6 for specific modifications and structure information related to the CFB RNAi agents, including (NAG37)s ligand). The CFB RNAi agents in Groups 2-17 each included nucleotide sequences that, while also being homologous to the mouse CFB gene transcript, were designed to inhibit expression of a human CFB gene at position 1667 of the CFB gene as noted in the Table 21 above, but had different chemical modifications. (See also, SEQ ID NO:1 and Table 2 for the CFB gene referenced).

The injections were performed between the skin and muscle (i.e. subcutaneous injections) into the loose skin over the neck and shoulder area. Four (4) mice in each group were tested (n=4). Mice were euthanized on study day 15, and total RNA was isolated from both livers following collection and homogenization. Mouse CFB mRNA expression was quantitated by probe-based quantitative PCR, normalized to mouse beta-actin expression, and expressed as fraction of vehicle control group (geometric mean, +/−95% confidence interval).

TABLE 22

Average Relative Mouse CFB mRNA at Sacrifice (Day 15) in Example 9 in Mouse Liver

| Group ID | Average Relative mCFB mRNA | Low (error) | High (error) |
|---|---|---|---|
| Group 1 (isotonic saline)) | 1.000 | 0.061 | 0.064 |
| Group 2 (0.5 mg/kg AD12088) | 0.763 | 0.058 | 0.063 |
| Group 3 (0.5 mg/kg AD12552) | 0.545 | 0.036 | 0.039 |
| Group 4 (0.5 mg/kg AD12559) | 0.462 | 0.039 | 0.043 |
| Group 5 (0.5 mg/kg AD12563) | 0.560 | 0.065 | 0.074 |
| Group 6 (0.5 mg/kg AD13123) | 0.701 | 0.078 | 0.088 |
| Group 7 (0.5 mg/kg AD13124) | 0.473 | 0.044 | 0.049 |
| Group 8 (0.5 mg/kg AD13125) | 0.458 | 0.029 | 0.030 |
| Group 9 (0.5 mg/kg AD13126) | 0.409 | 0.091 | 0.117 |
| Group 10 (0.5 mg/kg AD13127) | 0.877 | 0.091 | 0.102 |
| Group 11 (0.5 mg/kg AD13128) | 0.896 | 0.113 | 0.129 |
| Group 12 (0.5 mg/kg AD13036) | 0.712 | 0.051 | 0.055 |
| Group 13 (0.5 mg/kg AD13037) | 0.681 | 0.088 | 0.101 |
| Group 14 (0.5 mg/kg AD13038) | 0.416 | 0.043 | 0.048 |
| Group 15 (0.5 mg/kg AD13039) | 0.568 | 0.028 | 0.030 |
| Group 16 (0.5 mg/kg AD13040) | 0.383 | 0.038 | 0.042 |
| Group 17 (0.5 mg/kg AD13041) | 0.575 | 0.047 | 0.052 |

The data were normalized to the saline treated group (Group 1). As shown in Table 22, above, each of the CFB RNAi agents, which all targeted position 1667 of the CFB gene, showed at least numerical mCFB mRNA reductions in the liver, with several achieving significant inhibition.

Example 10. In Vivo Testing of CFB RNAi Agents in Wild-Type Mice

At day 1, six- to eight-week-old male C57bl/6 mice were given a single subcutaneous administration of 200 μl/20 g animal weight containing 0.5 mg/kg (mpk) of a CFB RNAi agent formulated in isotonic saline, or vehicle control (isotonic saline with no RNAi agent), which included the Groups in the following Table 23:

TABLE 23

Targeted Positions and Dosing Groups of Example 10

| Group | Targeted Gene Position (within SEQ ID NO: 1) | RNAi Agent and Dose | Dosing Regimen |
|---|---|---|---|
| 1 | N/A | Saline (no RNAi agent) | Single SQ injection on day 1 |
| 2 | 2399 | 0.5 mg/kg AD12964 | Single SQ injection on day 1 |
| 3 | 2399 | 0.5 mg/kg AD13816 | Single SQ injection on day 1 |
| 4 | 2399 | 0.5 mg/kg AD13817 | Single SQ injection on day 1 |
| 5 | 2399 | 0.5 mg/kg AD13818 | Single SQ injection on day 1 |
| 6 | 2399 | 0.5 mg/kg AD13819 | Single SQ injection on day 1 |
| 7 | 1667 | 0.5 mg/kg AD13126 | Single SQ injection on day 1 |
| 8 | 1667 | 0.5 mg/kg AD13436 | Single SQ injection on day 1 |
| 9 | 1667 | 0.5 mg/kg AD13930 | Single SQ injection on day 1 |
| 10 | 1667 | 0.5 mg/kg AD13931 | Single SQ injection on day 1 |
| 11 | 1667 | 0.5 mg/kg AD13932 | Single SQ injection on day 1 |
| 12 | 1667 | 0.5 mg/kg AD13933 | Single SQ injection on day 1 |
| 13 | 1667 | 0.5 mg/kg AD13934 | Single SQ injection on day 1 |
| 14 | 1667 | 0.5 mg/kg AD13935 | Single SQ injection on day 1 |

Each of the CFB RNAi agents included modified nucleotides that were conjugated at the 5' terminal end of the sense strand to a targeting ligand that included three N-acetyl-galactosamine groups (tridentate ligand) having the modified sequences as set forth in the duplex structures herein. (See Tables 3, 4, 5A, 5B, 5C, and 6 for specific modifications and structure information related to the CFB RNAi agents, including (NAG37)s ligand). The CFB RNAi agents each included nucleotide sequences that, while also being homologous to the mouse CFB gene transcript, were designed to inhibit expression of a human CFB gene at either position 1667 or at position 2399 of the CFB gene, as noted in the Table 23 above. (See also, SEQ ID NO:1 and Table 2 for the CFB gene referenced).

The injections were performed between the skin and muscle (i.e. subcutaneous injections) into the loose skin over the neck and shoulder area. Four (4) mice in each group were tested (n=4). Mice were euthanized on study day 15, and total RNA was isolated from both livers following collection and homogenization. Mouse CFB mRNA expression was quantitated by probe-based quantitative PCR, normalized to mouse beta-actin expression, and expressed as fraction of vehicle control group (geometric mean, +/−95% confidence interval).

TABLE 24

Average Relative Mouse CFB mRNA at Sacrifice (Day 15) in Example 10 in Mouse Liver

| Group ID | Average Relative mCFB mRNA | Low (error) | High (error) |
|---|---|---|---|
| Group 1 (isotonic saline) | 1.000 | 0.189 | 0.233 |
| Group 2 (0.5 mg/kg AD12964) | 0.403 | 0.048 | 0.054 |
| Group 3 (0.5 mg/kg AD13816) | 0.646 | 0.074 | 0.084 |
| Group 4 (0.5 mg/kg AD13817) | 0.635 | 0.097 | 0.114 |
| Group 5 (0.5 mg/kg AD13818) | 0.592 | 0.080 | 0.092 |
| Group 6 (0.5 mg/kg AD13819) | 0.678 | 0.109 | 0.129 |
| Group 7 (0.5 mg/kg AD13126) | 0.506 | 0.090 | 0.109 |
| Group 8 (0.5 mg/kg AD13436) | 0.516 | 0.076 | 0.089 |
| Group 9 (0.5 mg/kg AD13930) | 0.597 | 0.157 | 0.214 |
| Group 10 (0.5 mg/kg AD13931) | 0.939 | 0.157 | 0.189 |
| Group 11 (0.5 mg/kg AD13932) | 0.547 | 0.108 | 0.135 |
| Group 12 (0.5 mg/kg AD13933) | 0.410 | 0.047 | 0.053 |
| Group 13 (0.5 mg/kg AD13934) | 0.459 | 0.087 | 0.107 |
| Group 14 (0.5 mg/kg AD13935) | 0.437 | 0.116 | 0.159 |

The data were normalized to the saline treated group (Group 1). As shown in Table 24, above, Group 10 (AD13931) substituted a U nucleotide at position 13 of the antisense strand (5'→3'), thereby forming a U:G wobble with the CFB gene, and showed only minimal knockdown of mCFB mRNA rendering the CFB RNAi agent essentially inactive (compare AD13931 (Group 10) with AD13436 (Group 8)). The CFB RNAi agent of Group 11, meanwhile, included a mismatch to the target mRNA at position 15 of the antisense strand (5'→3'), also substituting a U nucleotide for a C and thus forming a U:G wobble with the CFB mRNA (and the sense strand), which was more tolerated than Group 10, but still was not as potent in activity as a version more fully complementary to the CFB gene target (compare AD13932 (Group 11) (~43% knockdown (0.547) with AD13436 (Group 8) (~49% knockdown (0.516).

Conversely, the CFB RNAi agent of Group 12 also included a mismatch to the target CFB mRNA where a U nucleotide was substituted for a C nucleotide, but this time at at position 16 of the antisense strand (5'→3), and despite this change to the antisense strand sequence to no longer form a Watson-Crick base pair with the reported CFB mRNA (SEQ ID NO:1) at this position (as well as with the sense strand of this particular CFB RNAi agent), but instead forming a U:G wobble, it surprisingly and unexpectedly lead to an approximately 10% improvement in CFB gene silencing activity, making it the most potent CFB RNAi agent in this particular study. (Compare AD13933 (Group 12) showing the highest level of knockdown in this study at 59% (0.410) from a single 0.5 mg/kg subcutaneous (SQ) dose, with AD13436 (Group 8) showing only 49% knockdown (0.516); see also Table 1 (position 1667 mRNA target sequence: UGUGGUGUCUGAGUACUUU (SEQ ID NO:45) (underline noting the previously discussed position 16 where AD13933 forms a G:U wobble base pair with the CFB gene transcript instead of a C:G base pair)). Similarly, Group 13 (AD13934, which inserted a G:U wobble pair at position 18 by modifying the antisense strand), while not quite as potent as Group 12, had improved inhibitory activity compared to the fully complementary sequence of Group 8

(AD13436). While the exact reason for the unexpected improvements seen from Group 12 (AD13933) and Group 13 (AD13934) compared to RNAi agents that have antisense strand sequences more fully complementary to the CFB gene target (AD13436) can only be hypothesized, and without being bound to any theory, it is believed that the changes to the thermodynamics of the CFB RNAi agent by modifying the nucleotide sequence at these specific positions lead to improved RISC loading of the antisense strand and/or improved endosomal escape properties to allow more of the RNAi agent into the desired cells, without causing a drop in inhibitory activity that would be expected from to the lack of full complementarity (and thus the potential for binding) to the CFB gene (as was seen, for example, with the change to the sequence made in Group 10).

Example 11. In Vivo Testing of CFB RNAi Agents in Wild-Type Mice

At day 1, six- to eight-week-old male C57bl/6 mice were given a single subcutaneous administration of 200 μl/20 g animal weight containing 0.3 mg/kg, 1.0 mg/kg, or 3.0 mg/kg of a CFB RNAi agent formulated in isotonic saline, or vehicle control (isotonic saline with no RNAi agent), which included the Groups in the following Table 25:

TABLE 25

Targeted Positions and Dosing Groups of Example 11

| Group | Targeted Gene Position (within SEQ ID NO: 1) | RNAi Agent and Dose | Dosing Regimen |
|---|---|---|---|
| 1 | N/A | Saline (no RNAi agent) | Single SQ injection on day 1 |
| 2 | 1667 | 0.3 mg/kg AD13126 | Single SQ injection on day 1 |
| 3 | 1667 | 1.0 mg/kg AD13126 | Single SQ injection on day 1 |
| 4 | 1667 | 3.0 mg/kg AD13126 | Single SQ injection on day 1 |
| 5 | 1667 | 0.3 mg/kg AD13933 | Single SQ injection on day 1 |
| 6 | 1667 | 1.0 mg/kg AD13933 | Single SQ injection on day 1 |
| 7 | 1667 | 3.0 mg/kg AD13933 | Single SQ injection on day 1 |
| 8 | 1667 | 0.3 mg/kg AD13934 | Single SQ injection on day 1 |
| 9 | 1667 | 1.0 mg/kg AD13934 | Single SQ injection on day 1 |
| 10 | 1667 | 3.0 mg/kg AD13934 | Single SQ injection on day 1 |
| 11 | 1667 | 0.3 mg/kg AD13935 | Single SQ injection on day 1 |
| 12 | 1667 | 1.0 mg/kg AD13935 | Single SQ injection on day 1 |
| 13 | 1667 | 3.0 mg/kg AD13935 | Single SQ injection on day 1 |

Each of the CFB RNAi agents included modified nucleotides that were conjugated at the 5' terminal end of the sense strand to a targeting ligand that included three N-acetyl-galactosamine groups (tridentate ligand) having the modified sequences as set forth in the duplex structures herein. (See Tables 3, 4, 5A, 5B, 5C, and 6 for specific modifications and structure information related to the CFB RNAi agents, including (NAG37)s ligand). The CFB RNAi agents each included nucleotide sequences that, while also being homologous to the mouse CFB gene transcript, were designed to inhibit expression of a human CFB gene at position 1667 of the CFB gene, as noted in the Table 25 above. (See also, SEQ ID NO: 1 and Table 2 for the CFB gene referenced).

The injections were performed between the skin and muscle (i.e. subcutaneous injections) into the loose skin over the neck and shoulder area. Four (4) mice in each group were tested (n=4). Mice were euthanized on study day 15, and total RNA was isolated from both livers following collection and homogenization. Mouse CFB mRNA expression was quantitated by probe-based quantitative PCR, normalized to mouse beta-actin expression, and expressed as fraction of vehicle control group (geometric mean, +/−95% confidence interval).

TABLE 26

Average Relative Mouse CFB mRNA at Sacrifice (Day 15) in Example 11 in Mouse Liver

| Group ID | Average Relative mCFB mRNA | Low (error) | High (error) |
|---|---|---|---|
| Group 1 (isotonic saline) | 1.000 | 0.137 | 0.158 |
| Group 2 (0.3 mg/kg AD13126) | 0.509 | 0.077 | 0.091 |
| Group 3 (1.0 mg/kg AD13126) | 0.220 | 0.029 | 0.033 |
| Group 4 (3.0 mg/kg AD13126) | 0.074 | 0.012 | 0.015 |
| Group 5 (0.3 mg/kg AD13933) | 0.571 | 0.096 | 0.115 |
| Group 6 (1.0 mg/kg AD13933) | 0.354 | 0.080 | 0.104 |
| Group 7 (3.0 mg/kg AD13933) | 0.111 | 0.016 | 0.019 |
| Group 8 (0.3 mg/kg AD13934) | 0.753 | 0.230 | 0.331 |
| Group 9 (1.0 mg/kg AD13934) | 0.335 | 0.065 | 0.080 |
| Group 10 (3.0 mg/kg AD13934) | 0.082 | 0.014 | 0.017 |
| Group 11 (0.3 mg/kg AD13935) | 0.645 | 0.140 | 0.179 |
| Group 12 (1.0 mg/kg AD13935) | 0.246 | 0.036 | 0.042 |
| Group 13 (3.0 mg/kg AD13935) | 0.096 | 0.011 | 0.013 |

The data were normalized to the saline treated group (Group 1). As shown in Table 26, above, each of the CFB RNAi agents showed robust gene inhibition, and all four CFB RNAi agents tested exhibited a clear dose response.

Example 12. In Vivo Testing of CFB RNAi Agents in Cynomolgus Monkeys

CFB RNAi agents AD12964, AD13126, AD13933, and AD13934 were evaluated in cynomolgus monkeys (cynos). On day 1 and day 29, four groups of three male cynos (n=3 per group) were respectively administered a subcutaneous injection of 0.3 mL/kg (approximately 1.5 mL volume, depending on animal mass) containing 3.0 mg/kg (mpk) of the a CFB RNAi agent (one CFB RNAi agent per group), formulated in isotonic saline.

The CFB RNAi agents included modified nucleotides that were conjugated at the 5' terminal end of the sense strand to a targeting ligand that included three N-acetyl-galactosamine groups (tridentate ligand) having the modified sequences as set forth in the duplex structures herein. (See Tables 3, 4, 5A, 5B, 5C, and 6 for specific modifications and structure information related to the CFB RNAi agents, including (NAG37)s ligand).

On days −7 (pre-dose), 1 (pre-dose), 8, and 15, serum samples were collected. FIG. 1 shows serum cynomolgus monkey CFB (cCFB) protein levels normalized to day 1 pre-dose levels, plotted by each serum collection date measurement through week 2 (e.g., in FIG. 1, week 0 is day 1; week 4 is day 29).

Figure 2:
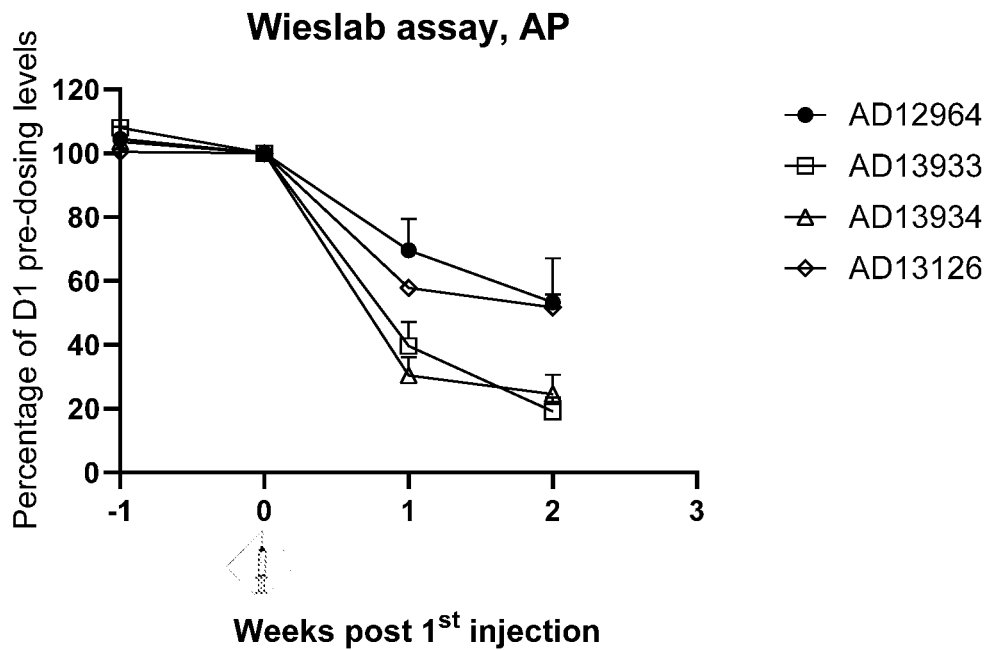
FIG. 2. Graph plotting relative Wieslab® AP (alternative pathway) assay results normalized to pre-dose in cynomolgus monkeys. Syringes indicate the timing of injections. (See Example 12).

Reductions in CFB are also correlated with compromised alternative pathway of complement (AP). The Wieslab® AP assay is an ELISA-based assay that detects the complement membrane attack complex (MAC), which is a cytolytic effector of immunity at the final step of the complement cascade. (See Example 13, below, for further discussion of Wieslab® AP assay that was used). As the plate is coated with specific activator of the alternative pathway, the kit is alternative-pathway specific. FIG. 2 shows the relative activity measured by Wieslab® AP assay normalized to D1 pre-dose levels, plotted by each serum collection date measurement through week 2 (e.g., in FIG. 1, week 0 is day 1; week 4 is day 29)

As shown in FIG. 1, each of the tested CFB RNAi agents evaluated resulted in significant serum CFB protein level reduction, but at different degrees. Similarly, as shown in FIG. 2, the Wieslab® AP assay evaluating complement alternative pathway activity supported the function loss correlated with CFB protein level reductions. By Day 15, the four tested CFB RNAi agents led to 70% (AD12964), 92% (AD13933), 87% (AD13934), and 73% (AD13126) of serum CFB protein reduction (FIG. 1), respectively. Correspondingly, these decreases of serum CFB levels were accompanied with a significant loss of complement alternative pathway activity measured by Wieslab® AP assay of 47% (AD12964), 81% (AD13933), 75% (AD13934), and 49% (AD13126), respectively (FIG. 2).

Example 13. In Vivo Testing of CFB RNAi Agents in Cynomolgus Monkeys in a 85 Days Duration For the study described in Example 12, the observations and assessments with respect to the CFB RNAi agent AD13933 treatment (but not the others) was maintained through day 85 post the first injection (day 1), in order to further characterize pharmacodynamic effects. The serum samples collected every the other week post 1st injection (i.e., week 0, 2, 4, 6, 8, 10 and 12) were analyzed.

Semi-quantitative measurement of the serum CFB levels of cynomolgus monkeys was carried out by Western blot using Jess (ProteinSimple, MN, USA). Protein concentration of serum samples were measured using Thermo Scientific™ Pierce™ BCA Protein Assay Kit (Cat #23227, Thermo Scientific™). The primary antibody detecting serum CFB were purchased from Sigma (Cat #HPA001817), and the primary antibody detecting Transferrin were purchased from R&D Systems (Cat #AF3987SP). Serum CFB protein levels were normalized with Transferrin levels and then compared with the corresponding Day 1 levels of each animal. All supplies required for Western blot assays were purchased from ProteinSimple.

Additionally, hemolysis activity was assessed for CFB RNAi agent AD13933. Hemolysis activity is sensitive to the reduction, absence, and/or inactivity of key components of the complement system. As noted, there are three pathways of complement activation: the alternative pathway, the classical pathway, and the lectin pathway. As all three activation pathways of the complement system require engagement of CFB to cause tissue injury in vivo (see, e.g., Thurman, J. & Holers, V. M., J. Immunol. Feb. 1, 2006, 176(3) 1305-1310), the activation of the alternative pathway of complement (AP) was measured to assess the effect of CFB knockdown to the complement system. The AP requires only Mg 2+ ions, whereas the classical and lectin pathways require both Ca2+ and Mg2+. This difference was used to assay only the AP in the presence of classical and lectin pathway proteins. Rabbit erythrocytes, which are known to spontaneously activate AP in most mammalian species, was applied in conducting the assay.

METHODS

Hemolysis Assay (Alternative Pathway)

Hemolysis assay for alternative pathway was carried out according to a modified protocol provided by Complement Technology, Inc. via measuring hemolysis of sensitized rabbit red blood cells. Briefly, for each reaction of 100 μL total volume in a 96-well plate, 8-30 μL of 2× diluted serum sample was incubated with 50 μL GVB0, 5 μL 0.1M MgEGTA and 25 μL of rabbit red blood cells (5×108/mL).

The mixture was incubated at 37° C. for 30 min, followed by adding 100 μL of GVBE to stop the reaction. After centrifugation, 100 μL of supernatant was transferred to a new plate. Hemolysis was determined by analyzing the optical density of the supernatants at 412 nM. Maximum blood cell lysate was achieved with 37° C. incubation for 60 minutes. All reagents were purchased from Complement Technology, Inc (Texas, USA).

One AP50 unit is defined as the amount of serum required to cause 50% of RBC lysis. This is calculated by subtracting the background OD from all samples, and then dividing them by the maximallysis control. The curves are plotted ln(dilution) vs ln(lysis). Three points surrounding 50% max lysis are selected to create a line that is used to calculate one AP50 unit. Based on the dilution the AP50 U/ml for each sample can be calculated.

Hemolysis Assay (Classical Pathway)

Hemolysis assay for classic pathway was carried out according to a modified protocol provided by Complement Technology, Inc. Briefly, for each reaction of 120 μL total volume with GVB++, serum samples were initially diluted 20×, then followed by 1:2.5 and three more times at 1:1.5 dilutions. Fifteen μL of GVB++-diluted serum sample was incubated with 10 μL sheep erythrocytes coated with rabbit antibody (EA cells, 5×108/mL). The mixture was incubated at 37° C. for 30 min, followed by adding 100 μL of cold GVBE to stop the reaction. After centrifugation at 1000 g for 5 minutes, 100 μL of supernatant was transferred to a new plate. Hemolysis was determined by analyzing the optical density of the supernatants at 412 nM. All reagents were purchased from Complement Technology, Inc (Texas, USA).

One CH50 unit is defined as the amount of serum required to cause 50% RBC lysis. This is calculated by subtracting the background OD from all samples, and then dividing them by the max lysis control. The curves are plotted ln(dilution) vs ln(lysis). Three points surrounding 50% max lysis are selected to create a line that is used to calculate one CH50 unit. Based on the dilution the CH50 U/ml for each sample can be calculated.

Wieslab® Assay (Alternative and Classical Pathways)

Quantitative measurement of complement alternative pathway and classic pathway activity of cynomolgus monkeys was carried out using an in vitro competitive ELISA kit (Cat #COMPLAP330, COMPLCP310, Svar Life Science AB). Serum samples were assayed according to the manufacturer's instructions.

Results

Treatment of AD13933 caused a rapid decrease in serum CFB levels after the first injection. By Day 15, CFB RNAi agent AD13933 showed 95% serum CFB protein reduction. The reduction was further boosted by the second injection administered on day 29. The low level of serum CFB protein was maintained at no more than 5% of the baseline levels through day 85 (week 12) (see FIG. 3). Data from individual cynos are provided in the following Table:

TABLE 30

Serum cCFB protein levels (normalized to Day 1), individual animals administered two doses of AD13933 on Days 1 and 29:

| Group ID | Day 1 | Day 15 | Day 29 | Day 43 | Day 57 | Day 71 | Day 85 |
| --- | --- | --- | --- | --- | --- | --- | --- |
| Cyno 1 | 1.000 | 0.0494 | 0.0114 | 0.0081 | 0.0073 | 0.0072 | 0.0243 |
| Cyno 2 | 1.000 | 0.0413 | 0.0684 | 0.0241 | 0.0221 | 0.0659 | 0.1148 |
| Cyno 3 | 1.000 | 0.0537 | 0.0431 | 0.0082 | 0.0093 | 0.0126 | 0.0235 |

Figure 3:
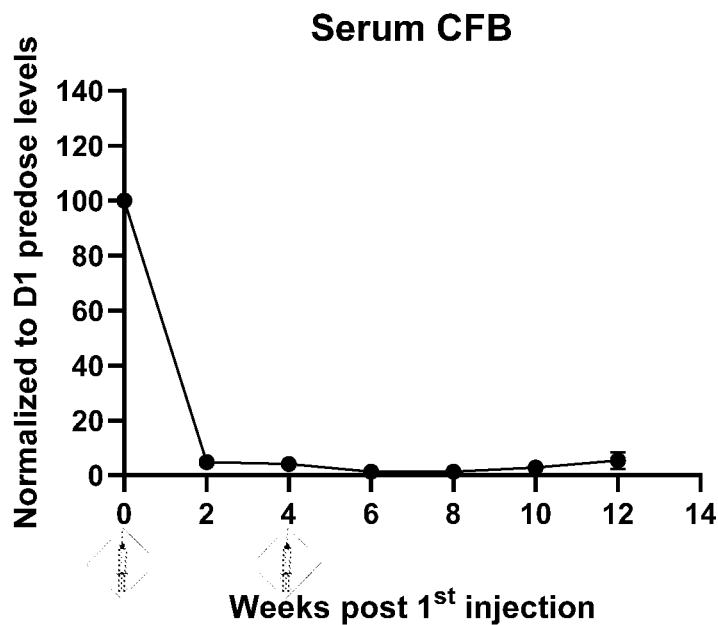
FIG. 3. Graph plotting relative serum cCFB protein levels normalized to pre-dose in cynomolgus monkeys. Syringes indicate the timing of injections. (See Example 13).

(See also FIG. 3 plotting mean values). As shown from the data presented herein, AD13933 lead to greater than approximately 95% reductions as early as Day 15 and exhibited strong inhibition through day 85 (with two of the three cynos still having approximately 98% reductions in cCFB protein levels (0.0243-Cyno 1; 0.0235-Cyno 3).

Figure 4:
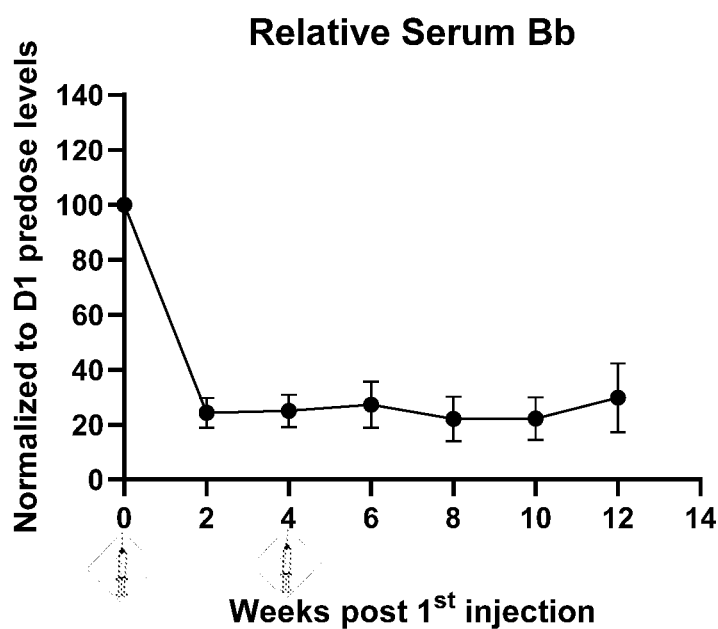
FIG. 4. Graph plotting relative serum cBb levels normalized to pre-dose in cynomolgus monkeys. Syringes indicate the timing of injections. (See Example 13).

Serum levels of Bb protein, a component of C3 convertase, was also assessed. In the alternative pathway of complement activation, CFB binds to C3b and cleaves C3 to generate C3b. CFB itself, however, is cleaved only when it is bound to C3b. The Bb fragment expresses serine protease activity but can cleave C3 and C5 only while it remains bound to C3b. CFB and C3 thus generate an amplification loop, in which Bb is an appropriate marker reflecting alternative pathway activation. Serum Bb levels were quantified via ELISA using MicroVue™ Bb Plus EIA (Quidel, San Diego, CA, USA). Serum Bb levels showed a similar pattern of reduction as CFB protein levels, and was kept below 30% of baseline levels from Day 15 to Day 85 (see FIG. 4).

Figure 5:
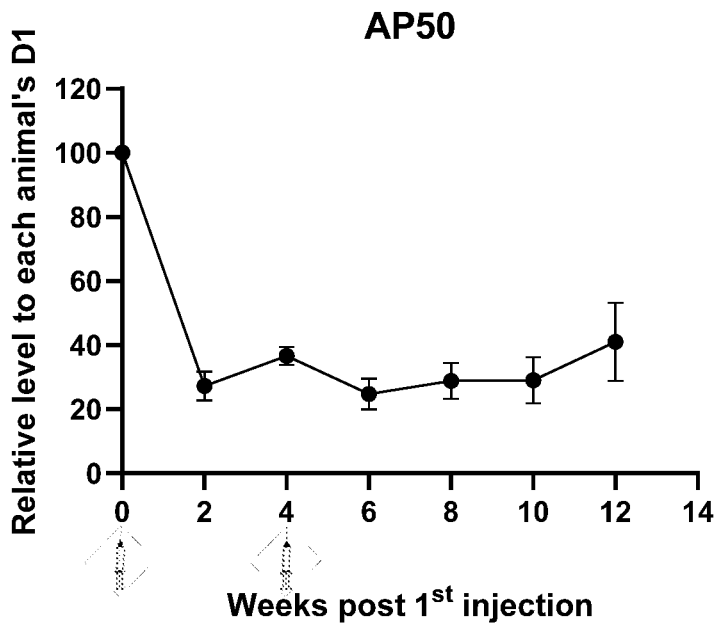
FIG. 5. Graph plotting relative AP50 Hemolysis assay (alternative pathway) results normalized to pre-dose in cynomolgus monkeys. Syringes indicate the timing of injections. (See Example 13).
Figure 6:
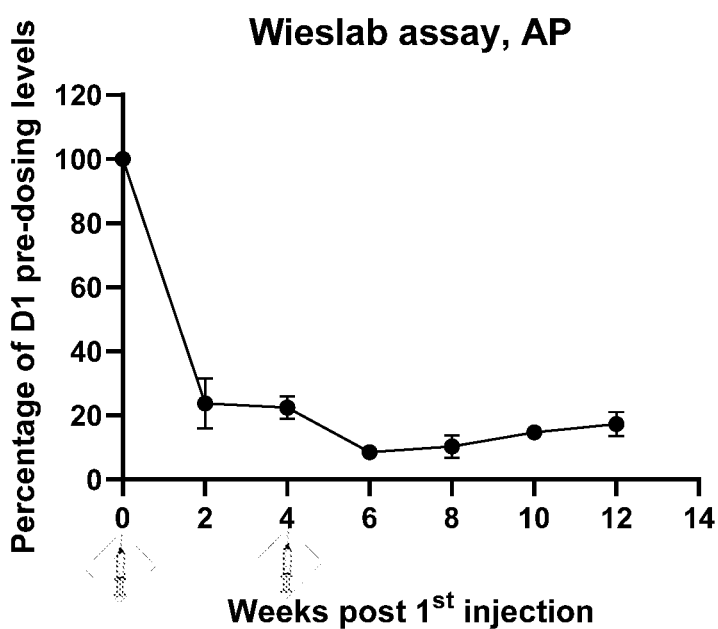
FIG. 6. Graph plotting relative Wieslab® AP (alternative pathway) assay results normalized to pre-dose in cynomolgus monkeys. Syringes indicate the timing of injections. (See Example 13).
Figure 7:
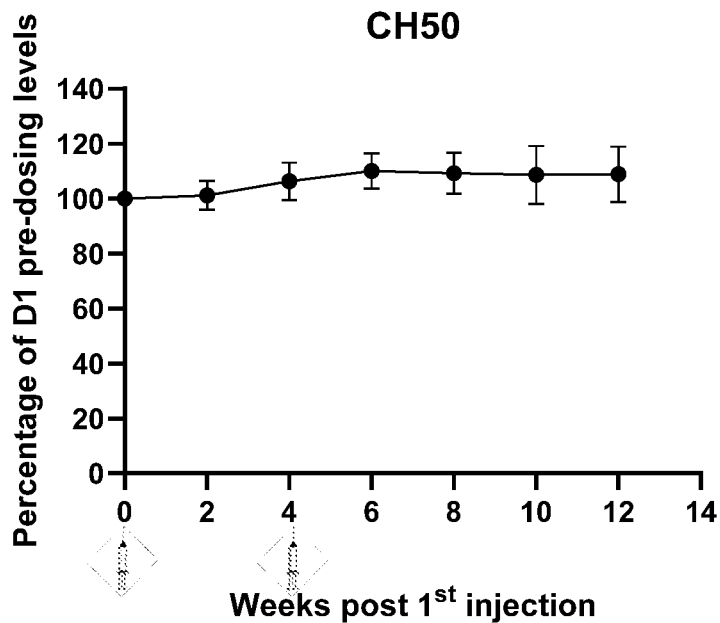
FIG. 7. Graph plotting relative CH50 Hemolysis assay (classical pathway) results normalized to pre-dose in cynomolgus monkeys. Syringes indicate the timing of injections. (See Example 13).
Figure 8:
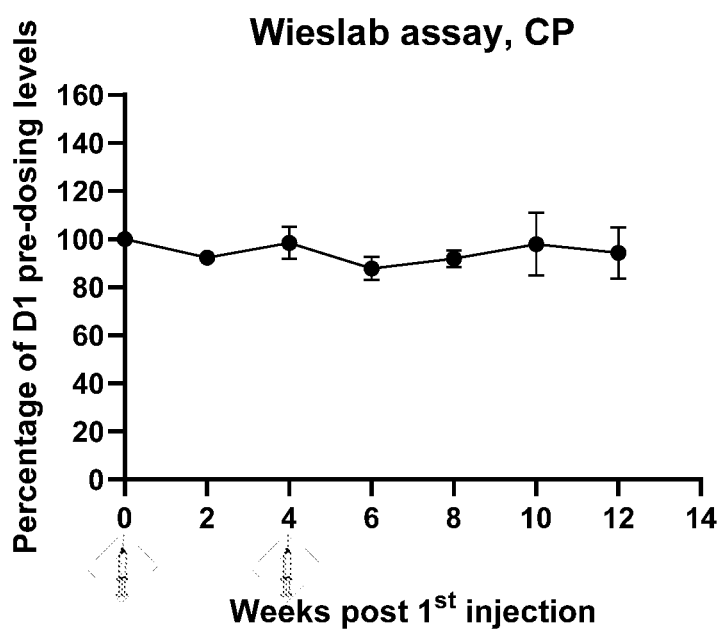
FIG. 8. Graph plotting relative Wieslab® CP (classical pathway) assay results normalized to pre-dose in cynomolgus monkeys. Syringes indicate the timing of injections. (See Example 13).

Correspondingly, the decreases seen of serum CFB and Bb levels were accompanied with a significant loss of complement alternative pathway activity measured by both hemolysis AP50 and Wieslab® AP assay, respectively. Two doses of AD13933 treatment at 3 mpk caused more than 75% decrease by AP hemolysis assay (Day 43, FIG. 5) and an approximately 90% reduction by Wieslab® AP assay (Day 43, FIG. 6). Further, it was established that CFB only participated in the alternative pathway in complement cascade. As was expected, there were no significant change of classical pathway activity detected, measured by hemolysis CH assay (CH50, FIG. 7) and Wieslab® CP assay (classical pathway) (FIG. 8).

Example 14. In Vivo Testing of CFB RNAi Agents in Wild-Type Mice

At day 1, six- to eight-week-old male C57bl/6 mice were given a single subcutaneous administration of 200 µl/20 g animal weight containing 0.5 mg/kg of a CFB RNAi agent formulated in isotonic saline, or vehicle control (isotonic saline with no RNAi agent), which included the Groups in the following Table 28:

TABLE 28

Targeted Positions and Dosing Groups of Example 14

| Group | Targeted Gene Position (within SEQ ID NO: 1) | RNAi Agent and Dose | Dosing Regimen |
| --- | --- | --- | --- |
| 1 | N/A | Saline (no RNAi agent) | Single SQ injection on day 1 |
| 2 | 1667 | 0.5 mg/kg AD13126 | Single SQ injection on day 1 |
| 3 | 2399 | 0.5 mg/kg AD12964 | Single SQ injection on day 1 |
| 4 | 2399 | 0.5 mg/kg AD13391 | Single SQ injection on day 1 |
| 5 | 2399 | 0.5 mg/kg AD13383 | Single SQ injection on day 1 |
| 6 | 2399 | 0.5 mg/kg AD14270 | Single SQ injection on day 1 |
| 7 | 2399 | 0.5 mg/kg AD14271 | Single SQ injection on day 1 |
| 8 | 2399 | 0.5 mg/kg AD14272 | Single SQ injection on day 1 |
| 9 | 2399 | 0.5 mg/kg AD14273 | Single SQ injection on day 1 |
| 10 | 2399 | 0.5 mg/kg AD14274 | Single SQ injection on day 1 |
| 11 | 2399 | 0.5 mg/kg AD14275 | Single SQ injection on day 1 |
| 12 | 2399 | 0.5 mg/kg AD14276 | Single SQ injection on day 1 |
| 13 | 2399 | 0.5 mg/kg AD14277 | Single SQ injection on day 1 |
| 14 | 2399 | 0.5 mg/kg AD14278 | Single SQ injection on day 1 |
| 15 | 2399 | 0.5 mg/kg AD14279 | Single SQ injection on day 1 |
| 16 | 2399 | 0.5 mg/kg AD14280 | Single SQ injection on day 1 |

TABLE 28-continued

Targeted Positions and Dosing Groups of Example 14

| Group | Targeted Gene Position (within SEQ ID NO: 1) | RNAi Agent and Dose | Dosing Regimen |
| --- | --- | --- | --- |
| 17 | 2399 | 0.5 mg/kg AD14281 | Single SQ injection on day 1 |
| 18 | 2399 | 0.5 mg/kg AD14282 | Single SQ injection on day 1 |
| 19 | 2399 | 0.5 mg/kg AD14283 | Single SQ injection on day 1 |
| 20 | 2399 | 0.5 mg/kg AD14284 | Single SQ injection on day 1 |

Each of the CFB RNAi agents included modified nucleotides that were conjugated at the 5' terminal end of the sense strand to a targeting ligand that included three N-acetylgalactosamine groups (tridentate ligand) having the modified sequences as set forth in the duplex structures herein. (See Tables 3, 4, 5A, 5B, 5C, and 6 for specific modifications and structure information related to the CFB RNAi agents, including (NAG37)s ligand). The CFB RNAi agents each included nucleotide sequences that, while also being homologous to the mouse CFB gene transcript, were designed to inhibit expression of a human CFB gene at either position 1667 of the CFB gene (Group 2), or at position 2399 of the CFB gene (Groups 3-20), as noted in the Table 25 above. (See also, SEQ ID NO:1 and Table 2 for the CFB gene referenced).

The injections were performed between the skin and muscle (i.e. subcutaneous injections) into the loose skin over the neck and shoulder area. Four (4) mice in each group were tested (n=4). Mice were euthanized on study day 15, and total RNA was isolated from both livers following collection and homogenization. Mouse CFB mRNA expression was quantitated by probe-based quantitative PCR, normalized to mouse beta-actin expression, and expressed as fraction of vehicle control group (geometric mean, +/−95% confidence interval).

TABLE 29

Average Relative Mouse CFB mRNA at Sacrifice (Day 15) in Example 13 in Mouse Liver

| Group ID | Average Relative mCFB mRNA | Low (error) | High (error) |
| --- | --- | --- | --- |
| Group 1 (No Treatment) | 1.000 | 0.123 | 0.140 |
| Group 2 (0.5 mg/kg AD13126) | 0.501 | 0.072 | 0.083 |
| Group 3 (0.5 mg/kg AD12964) | 0.389 | 0.092 | 0.120 |
| Group 4 (0.5 mg/kg AD13391) | 0.475 | 0.074 | 0.087 |
| Group 5 (0.5 mg/kg AD13383) | 0.399 | 0.071 | 0.087 |
| Group 6 (0.5 mg/kg AD14270) | 0.433 | 0.064 | 0.075 |
| Group 7 (0.5 mg/kg AD14271) | 0.435 | 0.095 | 0.121 |
| Group 8 (0.5 mg/kg AD14272) | 0.424 | 0.058 | 0.067 |
| Group 9 (0.5 mg/kg AD14273) | 0.621 | 0.097 | 0.115 |
| Group 10 (0.5 mg/kg AD14274) | 0.600 | 0.058 | 0.064 |
| Group 11 (0.5 mg/kg AD14275) | 0.616 | 0.097 | 0.116 |
| Group 12 (0.5 mg/kg AD14276) | 0.409 | 0.056 | 0.065 |
| Group 13 (0.5 mg/kg AD14277) | 0.500 | 0.143 | 0.201 |
| Group 14 (0.5 mg/kg AD14278) | 0.462 | 0.066 | 0.077 |
| Group 15 (0.5 mg/kg AD14279) | 0.579 | 0.139 | 0.184 |
| Group 16 (0.5 mg/kg AD14280) | 0.706 | 0.040 | 0.043 |
| Group 17 (0.5 mg/kg AD14281) | 0.525 | 0.060 | 0.067 |
| Group 18 (0.5 mg/kg AD14282) | 0.678 | 0.150 | 0.193 |
| Group 19 (0.5 mg/kg AD14283) | 0.677 | 0.128 | 0.158 |
| Group 20 (0.5 mg/kg AD14284) | 0.552 | 0.096 | 0.116 |

The data were normalized to the saline treated group (Group 1). As shown in Table 26, above, each of the CFB RNAi agents showed inhibition of CFB gene expression with several achieving approximately or greater than 50% reductions in mCFB mRNA.

Example 15. Phase I/IIa Clinical Trial To Evaluate the Safety, Tolerability, Pharmacokinetics, and Pharmacodynamics of Single and Multiple Doses of a CFB RNAi Agent In Healthy Human Volunteers and Adult Subjects With Complement-Mediated Kidney Disease A Phase 1/2a, single and multiple dose-escalating study to evaluate the safety, tolerability, pharmacokinetics and pharmacodynamic effects of CFB RNAi agent AD13933 formulated in sodium phosphate buffer in adult healthy volunteers as well as in subjects with complement-mediated kidney disease, is being initiated. The CFB RNAi agent AD13933 was formulated at 200 mg/mL (salt free or free acid basis) in an aqueous buffer solution containing 0.5 mM sodium phosphate monobasic and 0.5 mM sodium phosphate dibasic, in water for injection ("Formulated CFB RNAi Drug Substance").

Five single-ascending-dose (SAD) cohorts are each anticipated to enroll 6 normal healthy volunteer (NHV) subjects (randomized 2:1 drug:placebo) to receive Formulated CFB RNAi Drug Substance at a dose of 25 mg, 50 mg, 100 mg, 200 mg, or 400 mg, or placebo (i.e., 4 subjects are to receive the CFB RNAi agent, and 2 subjects are to receive placebo for each cohort) with safety checks at Day 15. Additionally, three multiple-ascending-dose (MAD) cohorts are each anticipated to enroll 6 NHV subjects (randomized 2:1 drug:placebo) to receive Formulated CFB RNAi Drug Substance at a dose of 100 mg, 200 mg, or 400 mg, or placebo, in two doses administered on Day 1 and Day 29. A cohort enrolling subjects with complement-mediated kidney disease will also be initiated, enrolling up to 18 patients with IgAN, to receive three total doses of Formulated CFB RNAi Drug Substance on Day 1, Day 29, and Day 113, at a dose level to be determined based on data from the SAD and MAD cohorts.

Example 16. In Vivo Testing of CFB RNAi Agents in Cynomolgus Monkeys

CFB RNAi agent AD13933 was evaluated in cynomolgus monkeys (cynos). On day 1 and day 29, three male cynos (n=3) were administered a subcutaneous injection of 0.3 mL/kg (approximately 1.5 mL volume, depending on animal mass) containing either 0.5 mg/kg (mpk), 1.5 mg/kg, or 4.5 mg/kg of CFB RNAi agent AD13933 formulated in isotonic saline.

The CFB RNAi agent AD13933 included modified nucleotides that were conjugated at the 5' terminal end of the sense strand to a targeting ligand that included three N-acetyl-galactosamine groups (tridentate ligand) having the modified sequences as set forth in the duplex structures herein. (See Tables 3, 4, 5A, 5B, 5C, and 6 for specific modifications and structure information related to the CFB RNAi agents, including (NAG37)s ligand).

On days −7 (pre-dose), 1 (pre-dose), 8, 15, 22, 29 (pre-second dose), 36, 43, 50, 57, 64, 71, 78, and 85 serum samples were collected.

Figure 9:
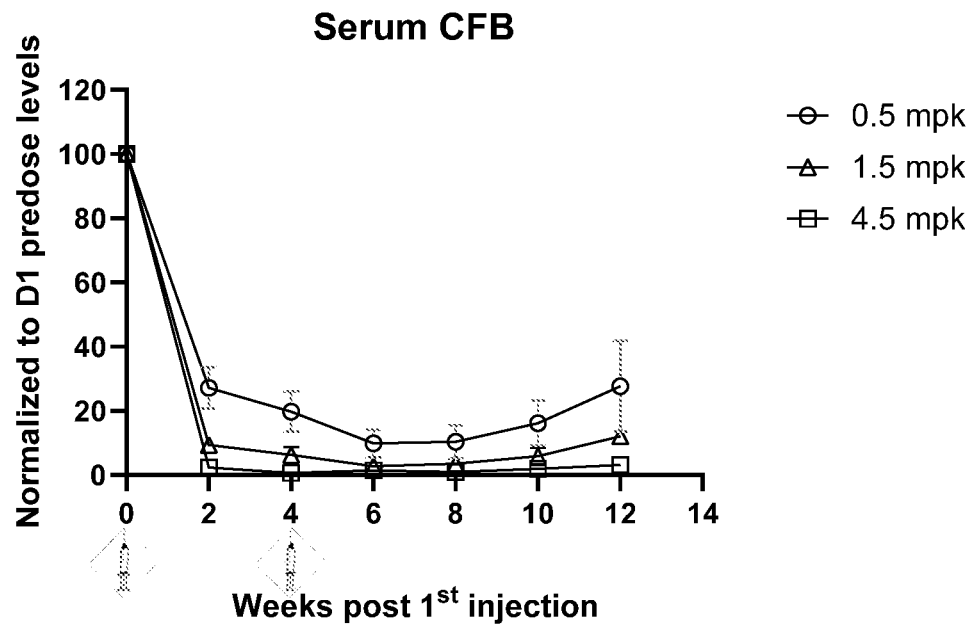
FIG. 9. Graph plotting relative serum cCFB protein levels achieved with CFB RNAi agent normalized to pre-dose in cynomolgus monkeys. Syringes indicate the timing of injections of CFB RNAi agent AD13933. (See Example 16).
Figure 10:
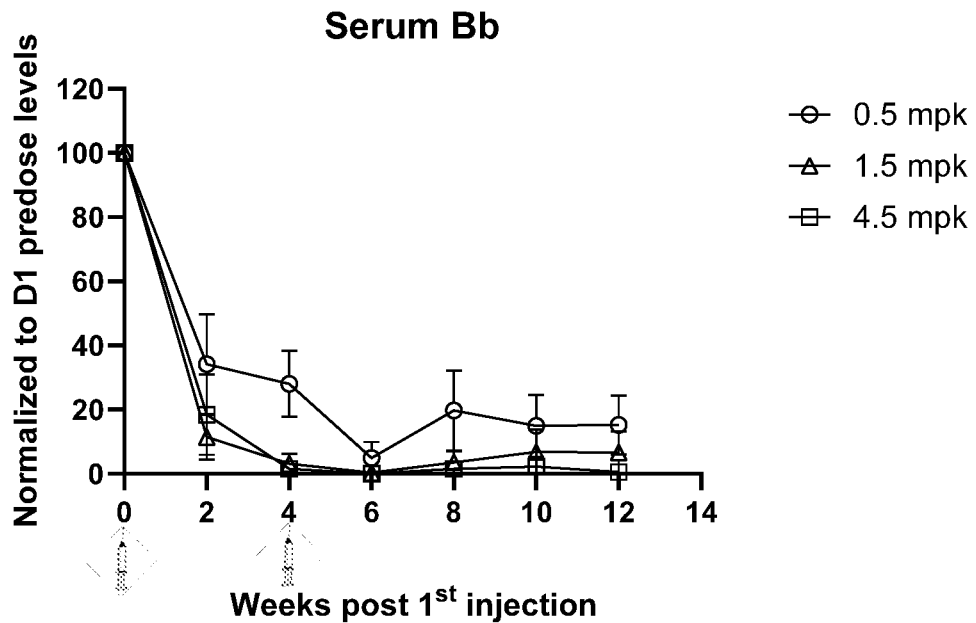
FIG. 10. Graph plotting relative serum cBb levels achieved with CFB RNAi agent AD13933 normalized to pre-dose in cynomolgus monkeys. Syringes indicate the timing of injections of CFB RNAi agent AD13933. (See Example 16).

The administration of CFB RNAi agent AD13933 caused a significant serum CFB decrease after two weeks of the first dose and such reduction showed a dose-dependent response. The nadir of serum CFB protein levels appeared on Day 43, where over 90% (for 0.5 mg/kg group) and 95% (for 4.5 mg/kg group) of reduction were detected compared with the corresponding their baseline levels (FIG. 9). The functional fragment of CFB in alternative pathway activation, Bb, was similarly significantly lowered by the CFB RNAi agent AD13933 treatment and showed over 95% decrease at the nadir in all treated groups (FIG. 10).

Figure 11:
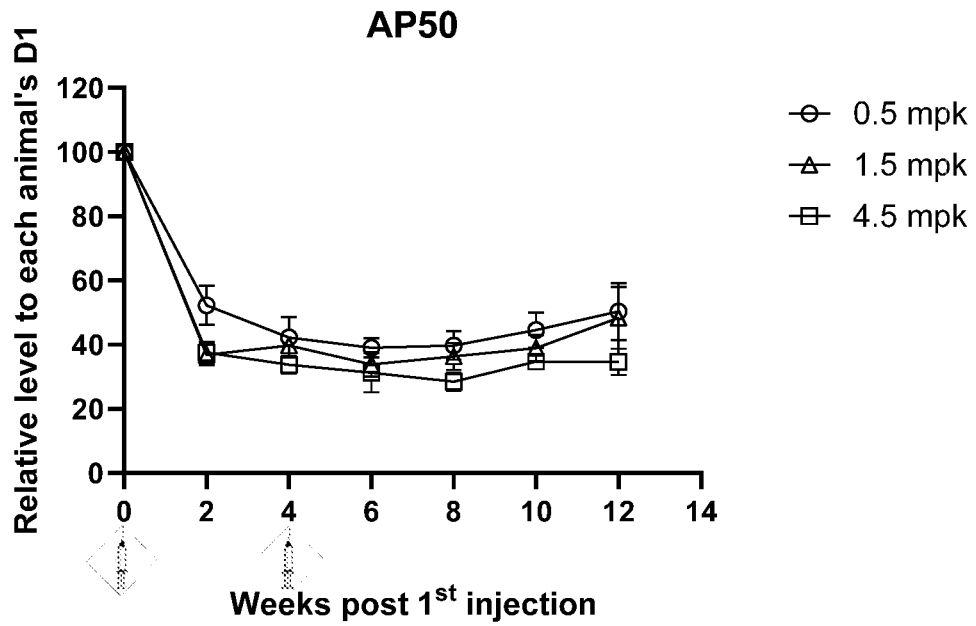
FIG. 11. Graph plotting relative AP50 Hemolysis assay (alternative pathway) results achieved with CFB RNAi agent AD13933 normalized to pre-dose in cynomolgus monkeys. Syringes indicate the timing of injections of CFB RNAi agent AD13933. (See Example 16).
Figure 12:
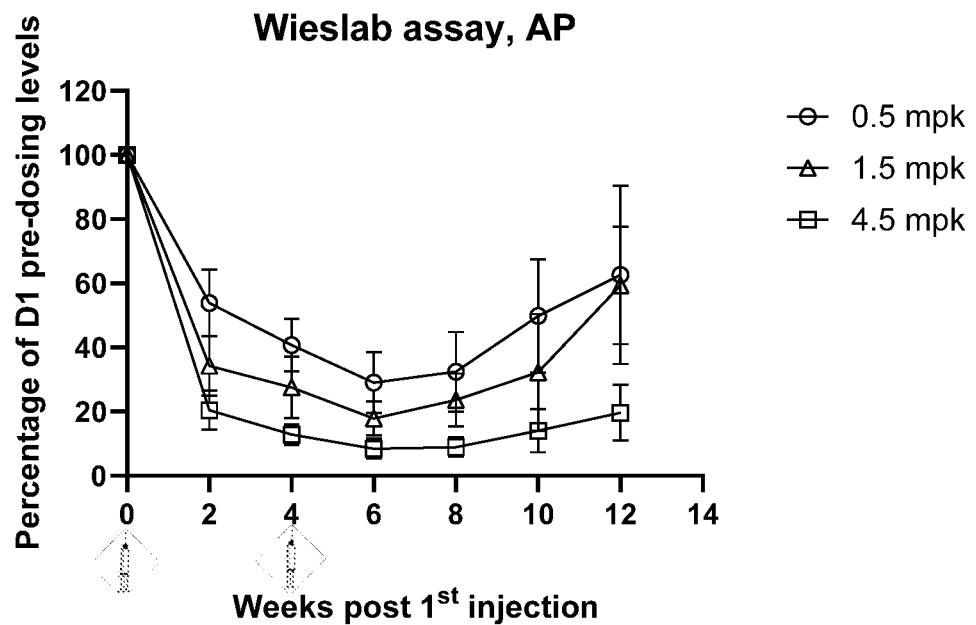
FIG. 12. Graph plotting relative Wieslab® AP (alternative pathway) assay results achieved with CFB RNAi agent AD13933 normalized to pre-dose in cynomolgus monkeys. Syringes indicate the timing of injections of CFB RNAi agent AD13933. (See Example 16).
Figure 13:
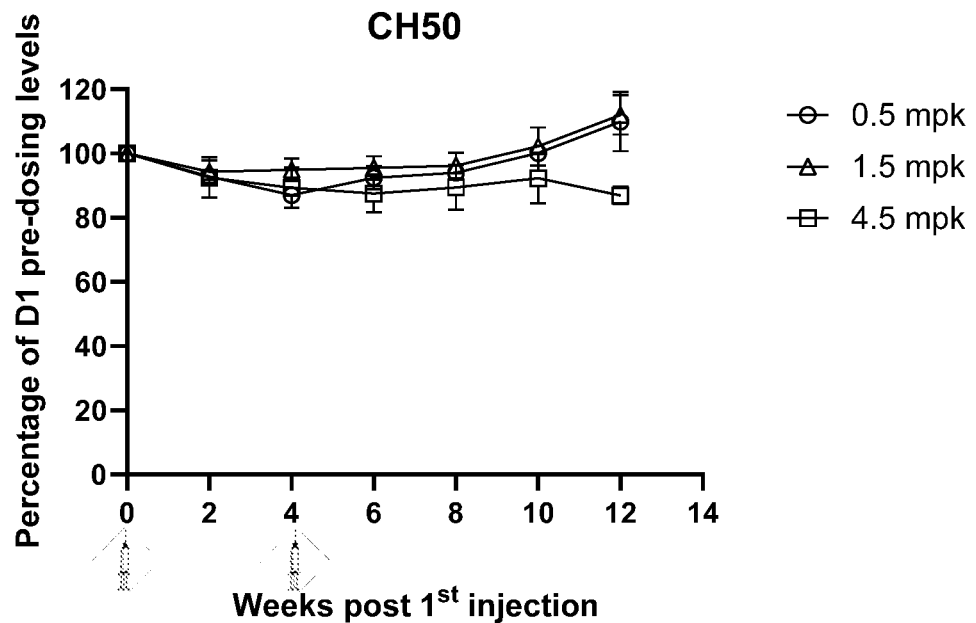
FIG. 13. Graph plotting relative CH50 Hemolysis assay (classical pathway) results normalized to pre-dose in cynomolgus monkeys. Syringes indicate the timing of injections of CFB RNAi agent AD13933. (See Example 16).
Figure 14:
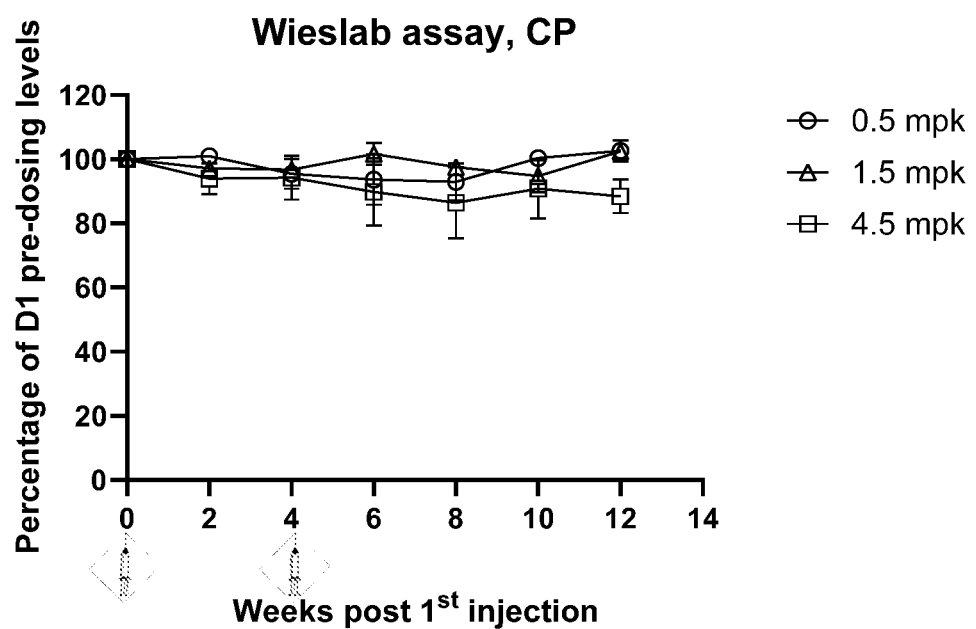
FIG. 14. Graph plotting relative Wieslab® CP (classical pathway) assay results normalized to pre-dose in cynomolgus monkeys. Syringes indicate the timing of injections of CFB RNAi agent AD13933. (See Example 16).
Figure 15A:
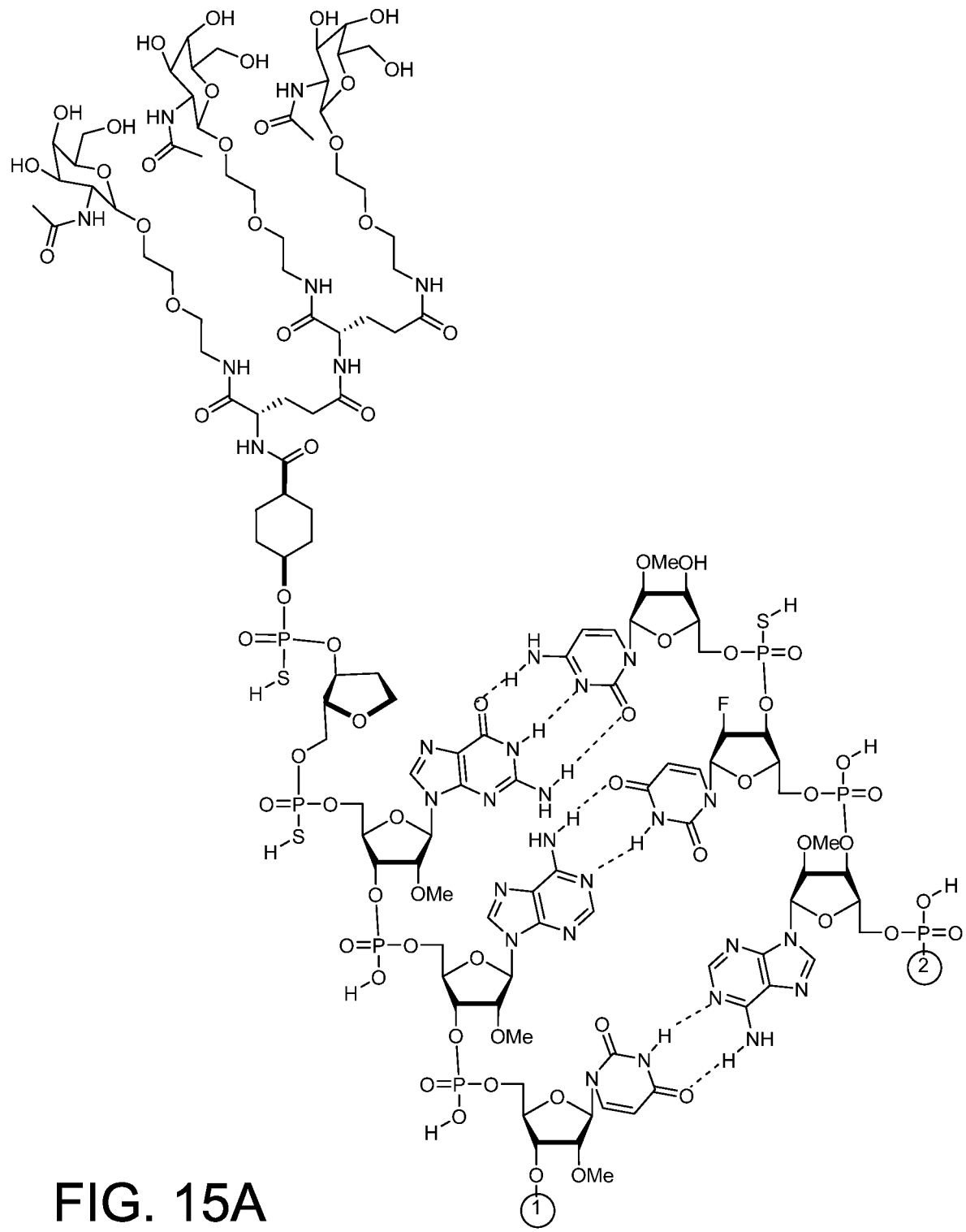
FIG. 15A-15D. Chemical structure representation of CFB RNAi agent AD12096 with the targeting ligand (NAG37)s linked to the 5' end of the sense strand (SEQ ID NOs:913/1085), shown as a free acid.
Figure 15B:
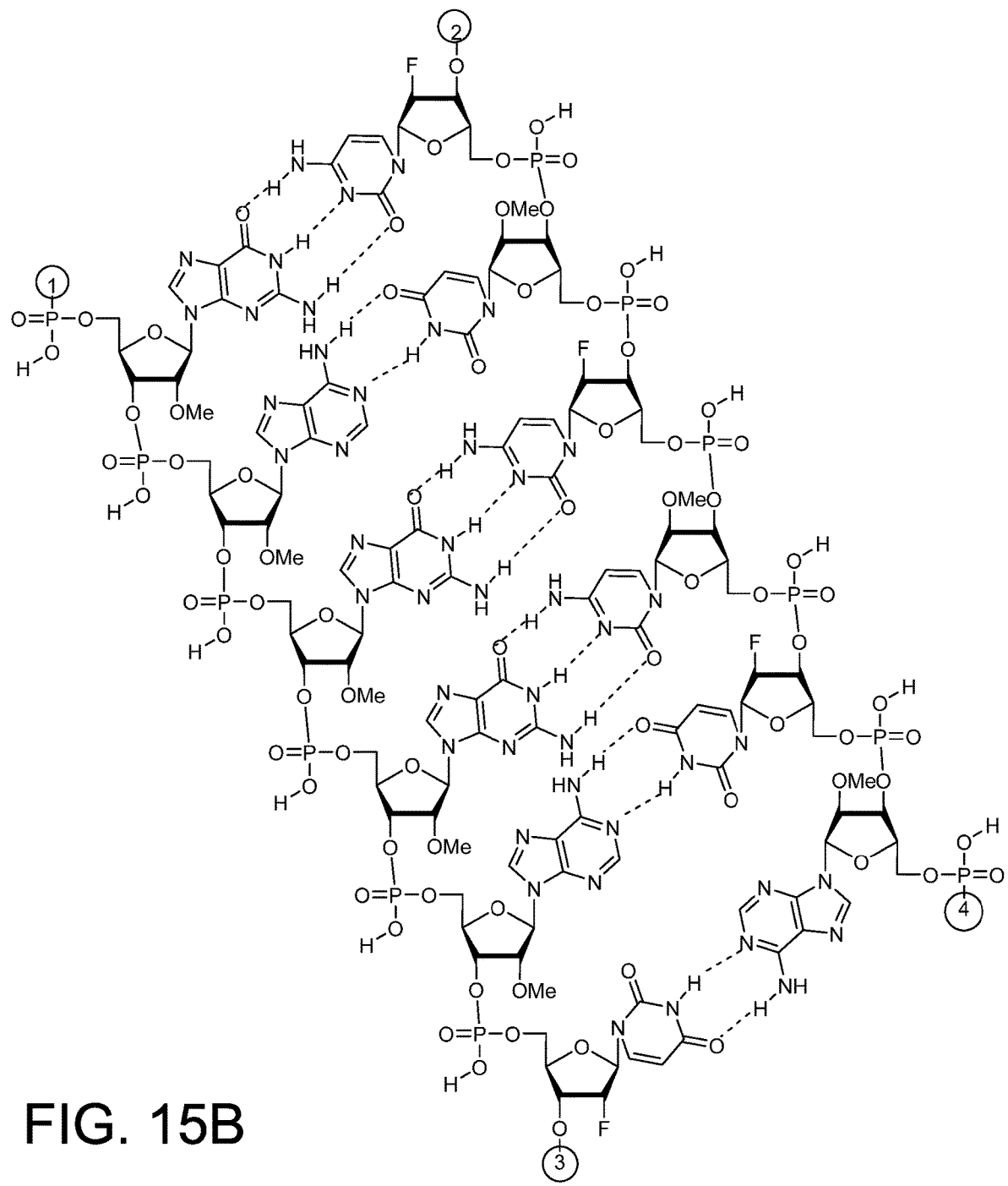
Figure 15C:
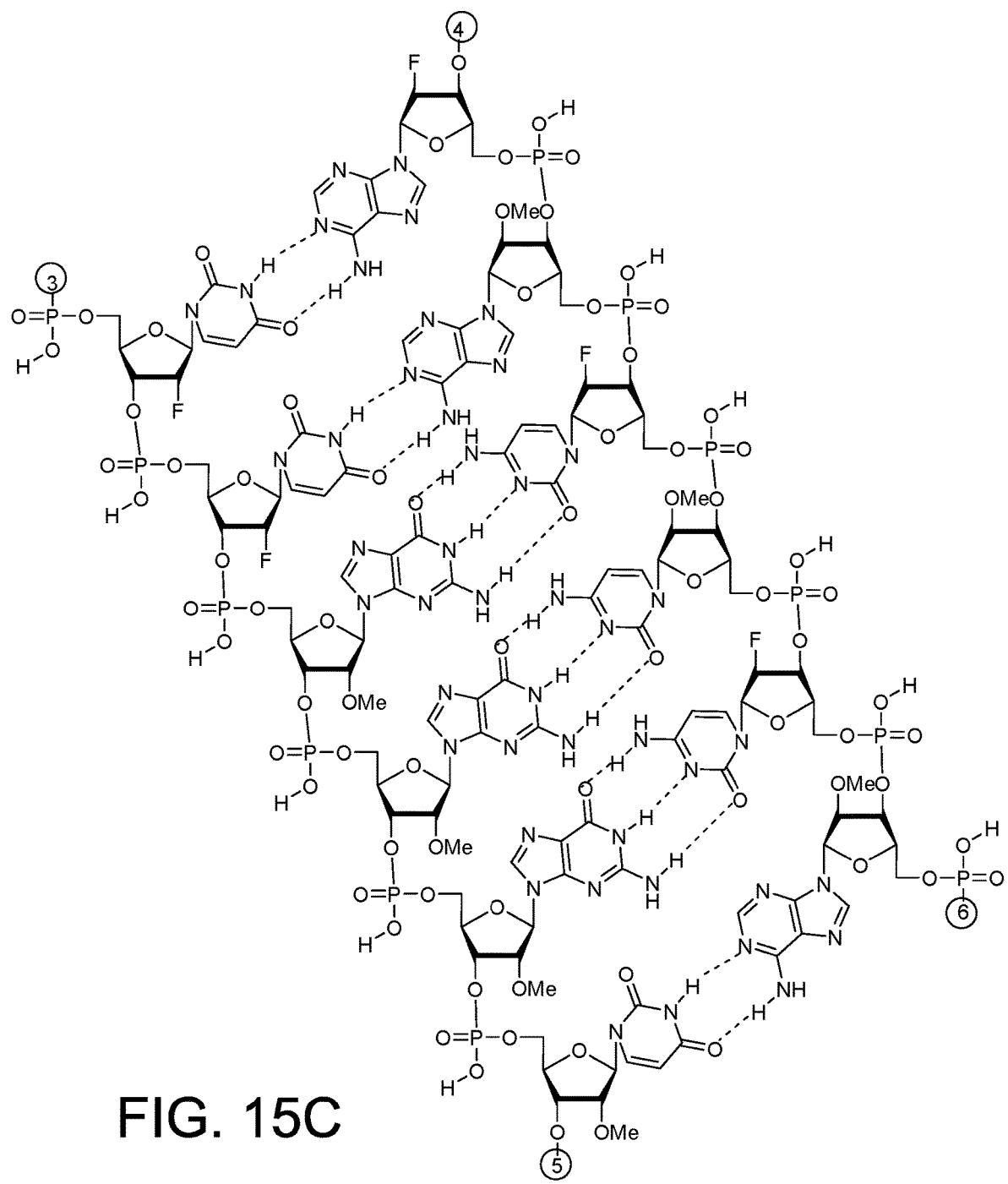
Figure 15D:
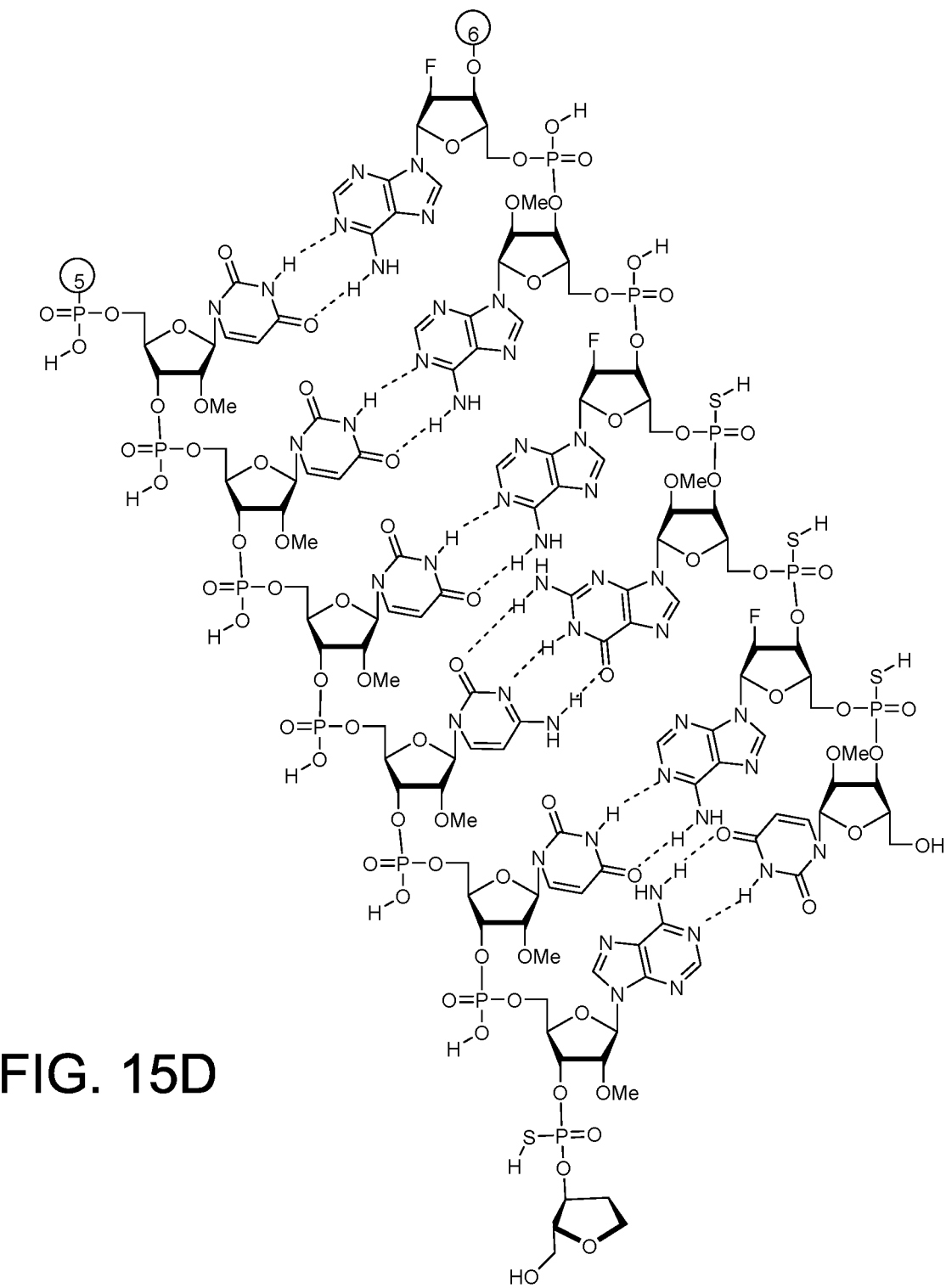
Figure 16A:
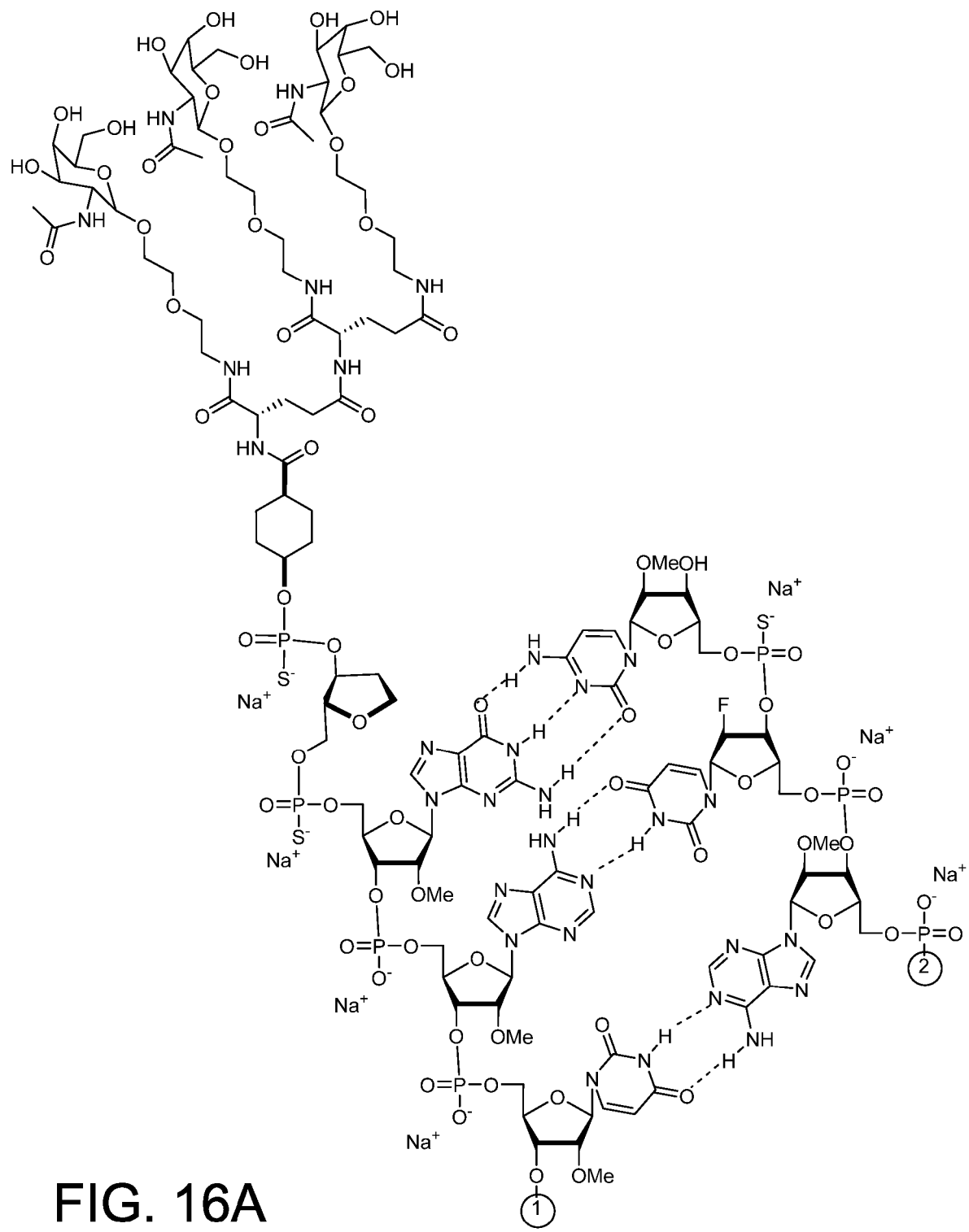
FIG. 16A-16D. Chemical structure representation of CFB RNAi agent AD12096 with the targeting ligand (NAG37)s linked to the 5' end of the sense strand (SEQ ID NOs:913/1085), shown as a sodium salt.
Figure 16B:
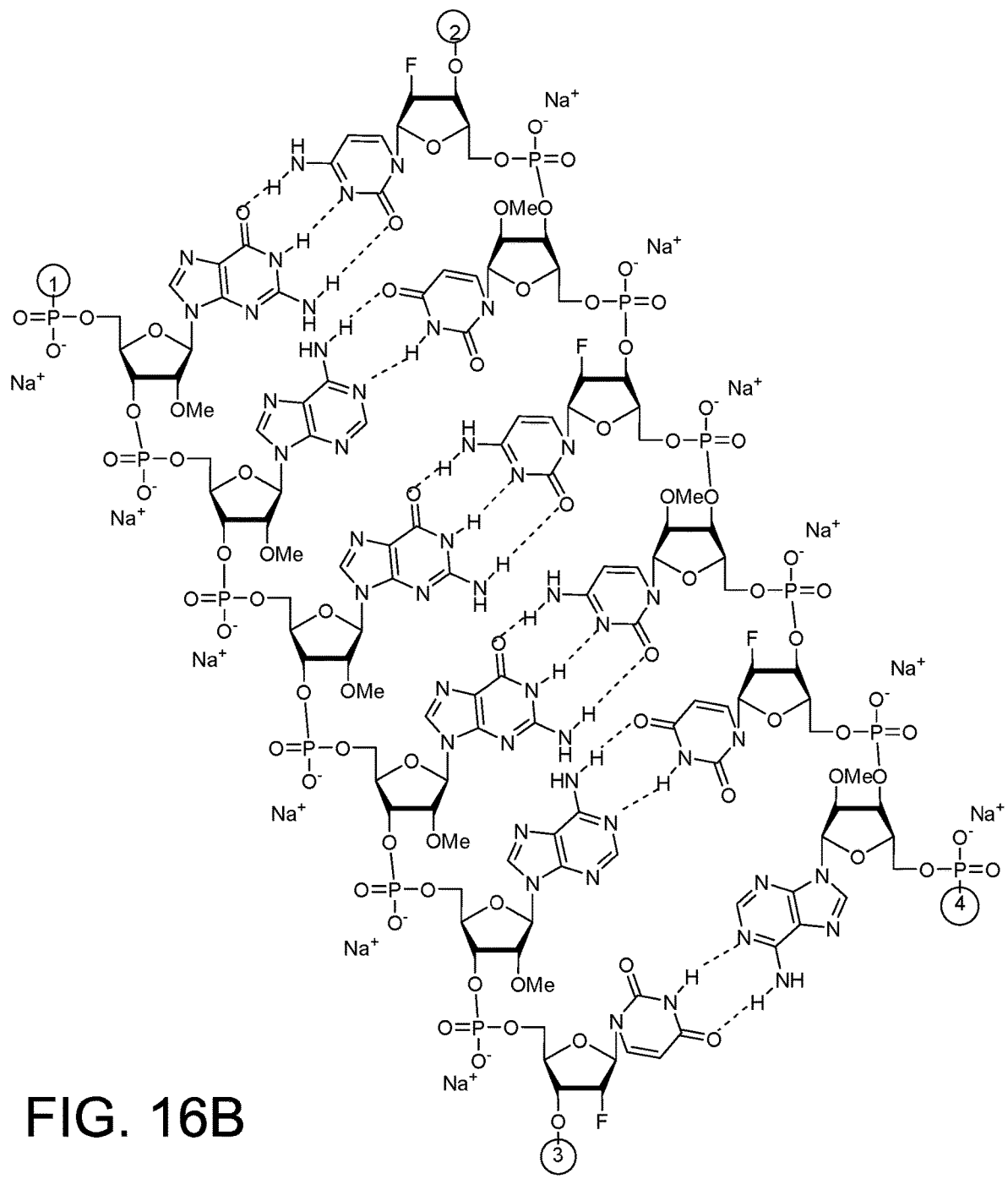
Figure 16C:
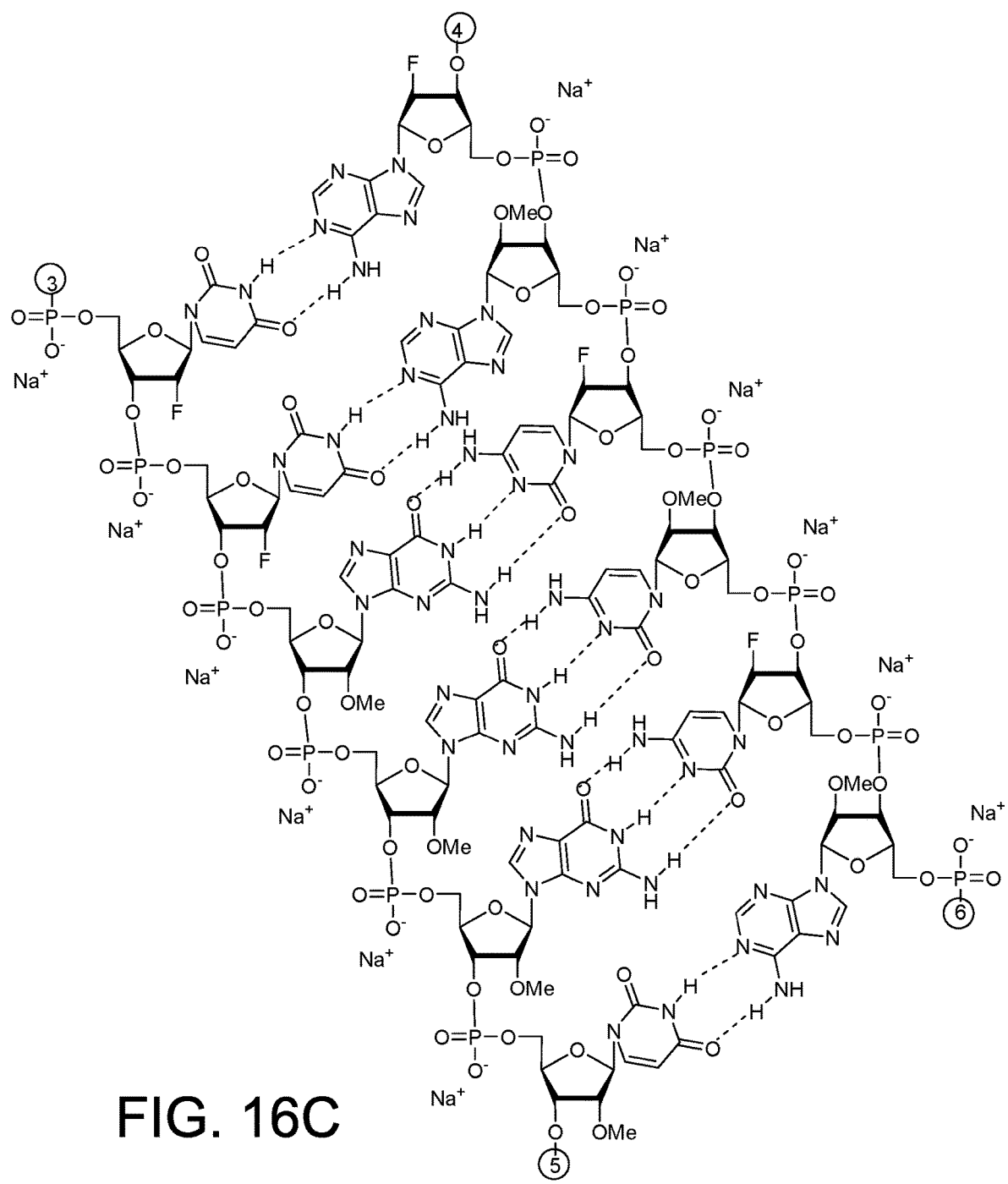
Figure 16D:
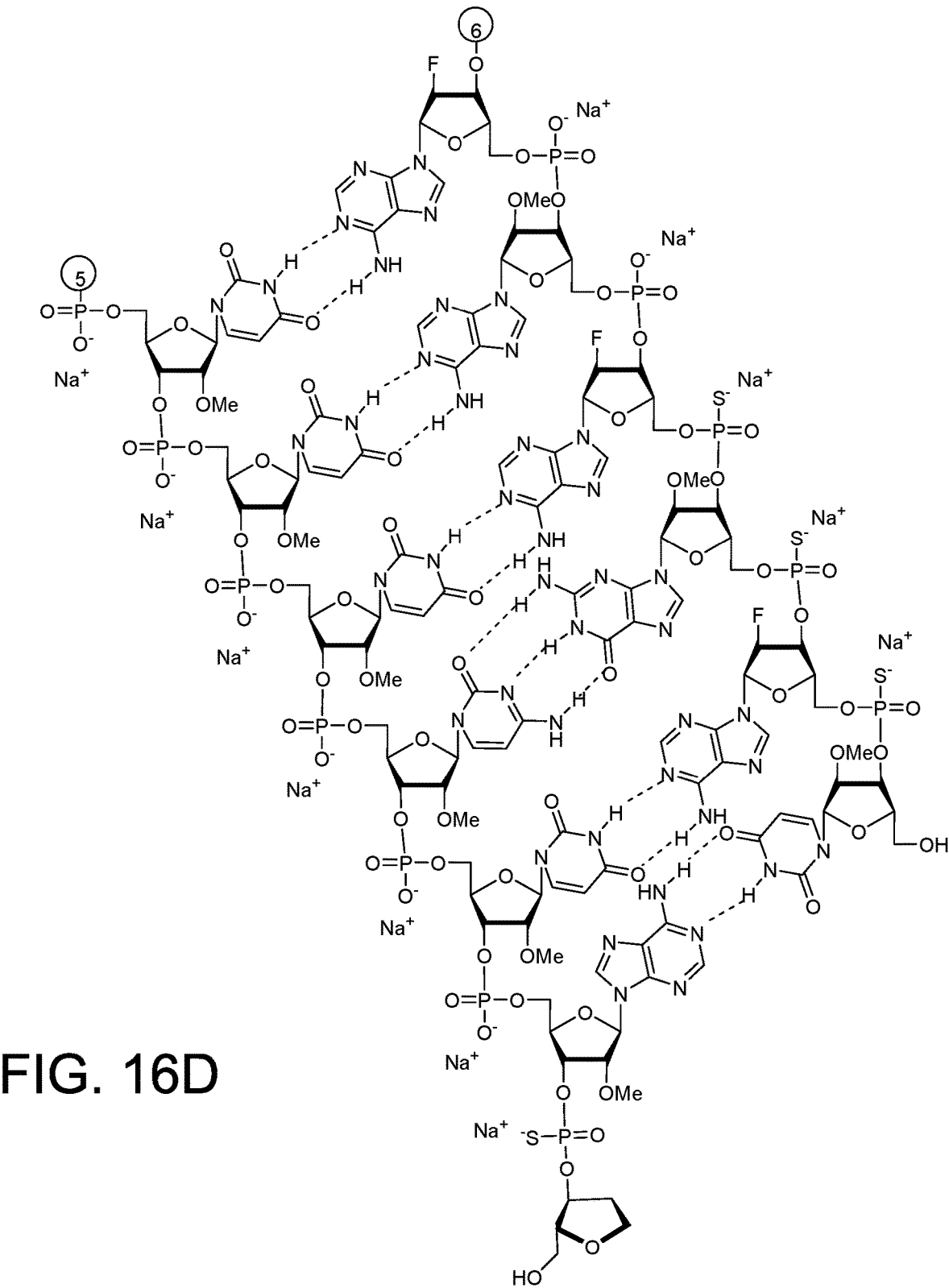
Figure 17A:
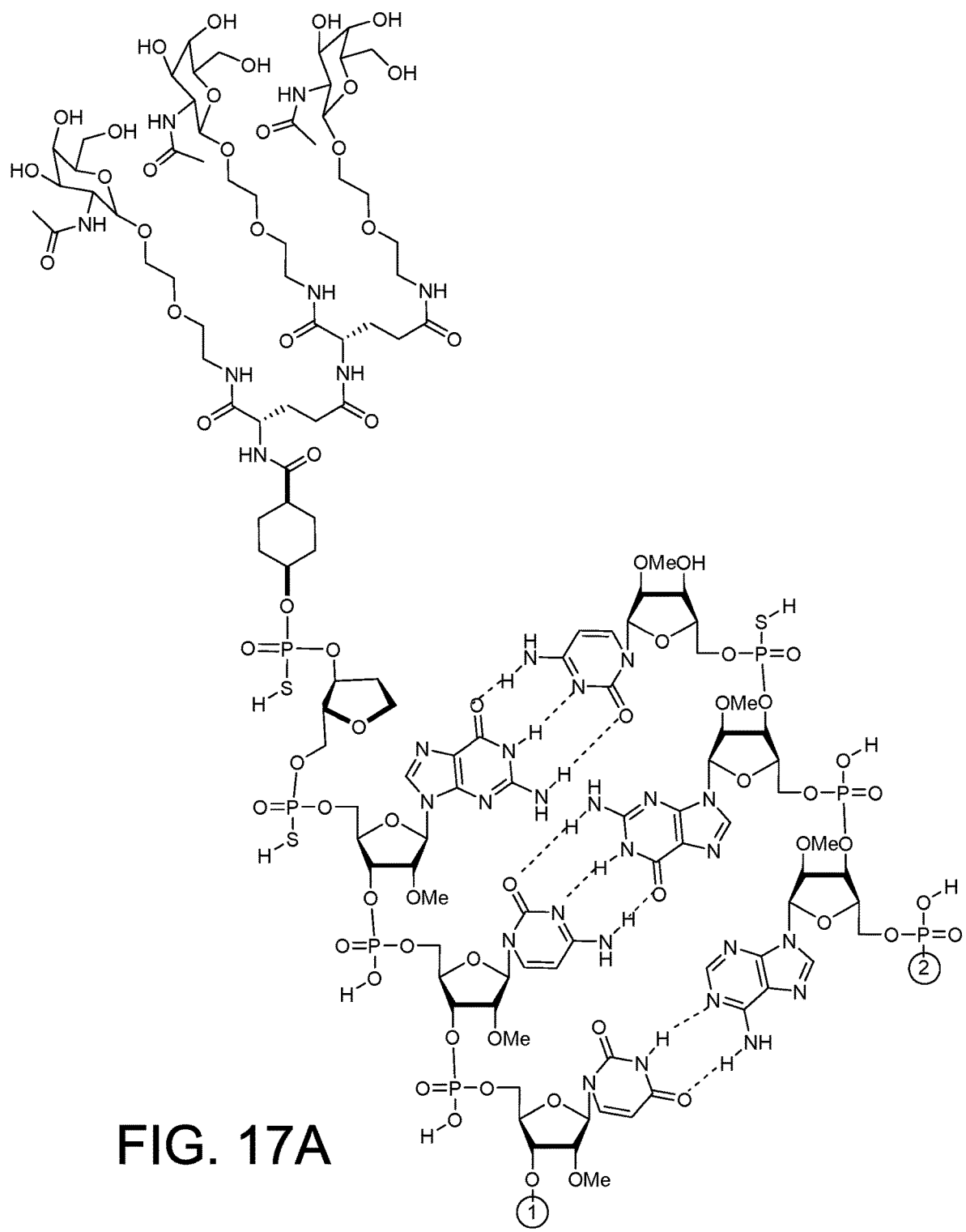
FIG. 17A-17D. Chemical structure representation of CFB RNAi agent AD13126 with the targeting ligand (NAG37)s linked to the 5' end of the sense strand (SEQ ID NOs:983/1077), shown as a free acid.
Figure 17B:
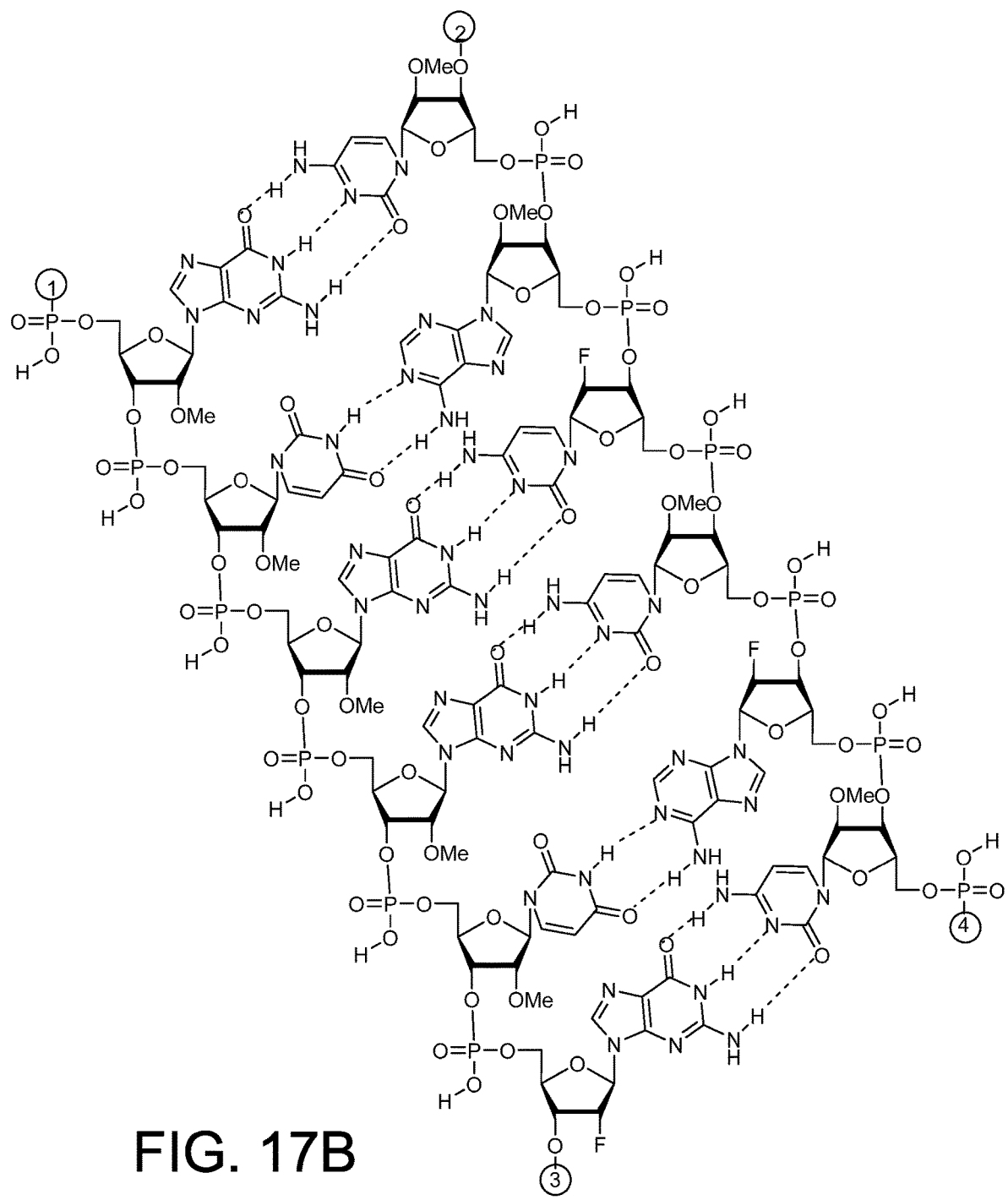
Figure 17C:
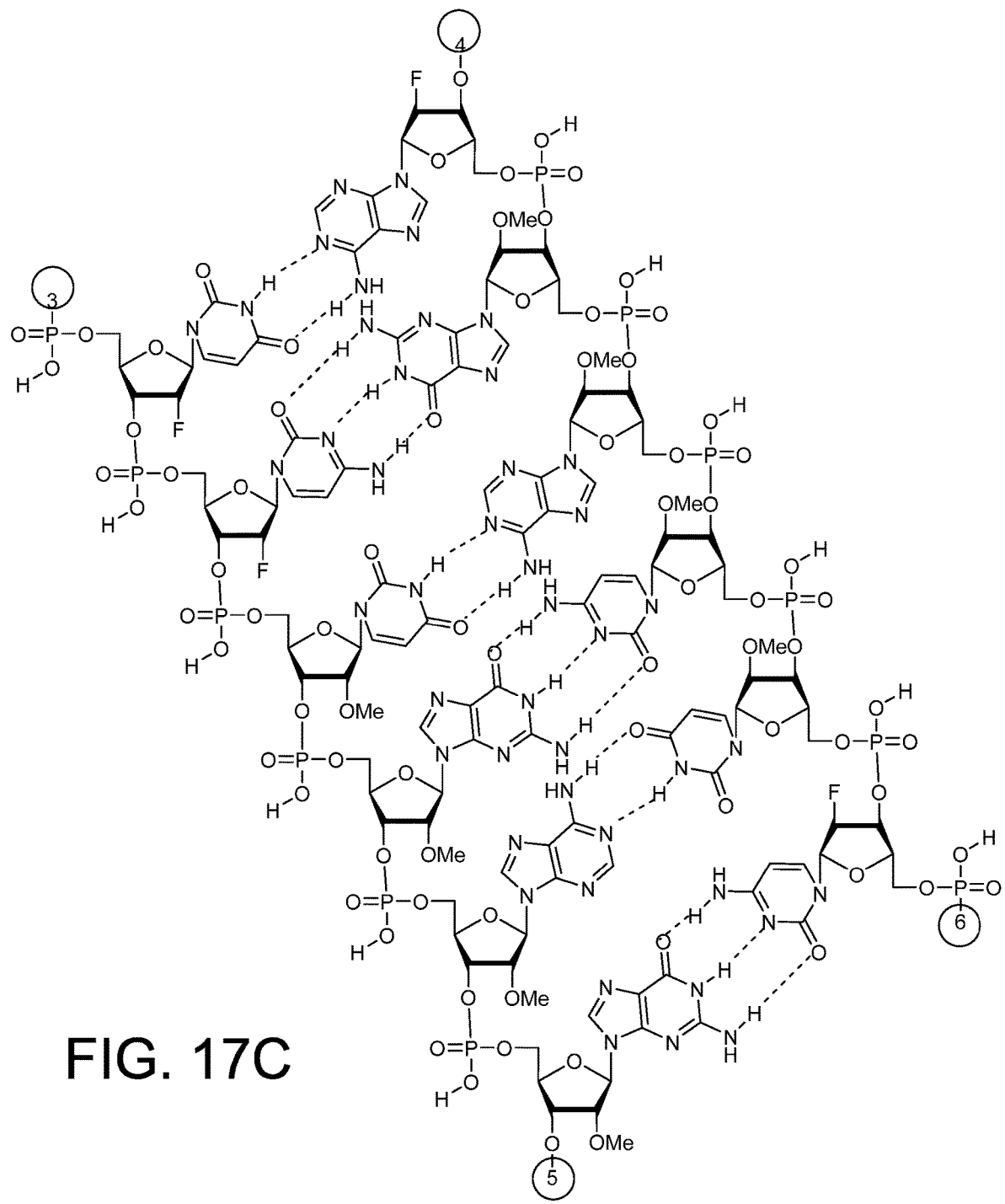
Figure 17D:
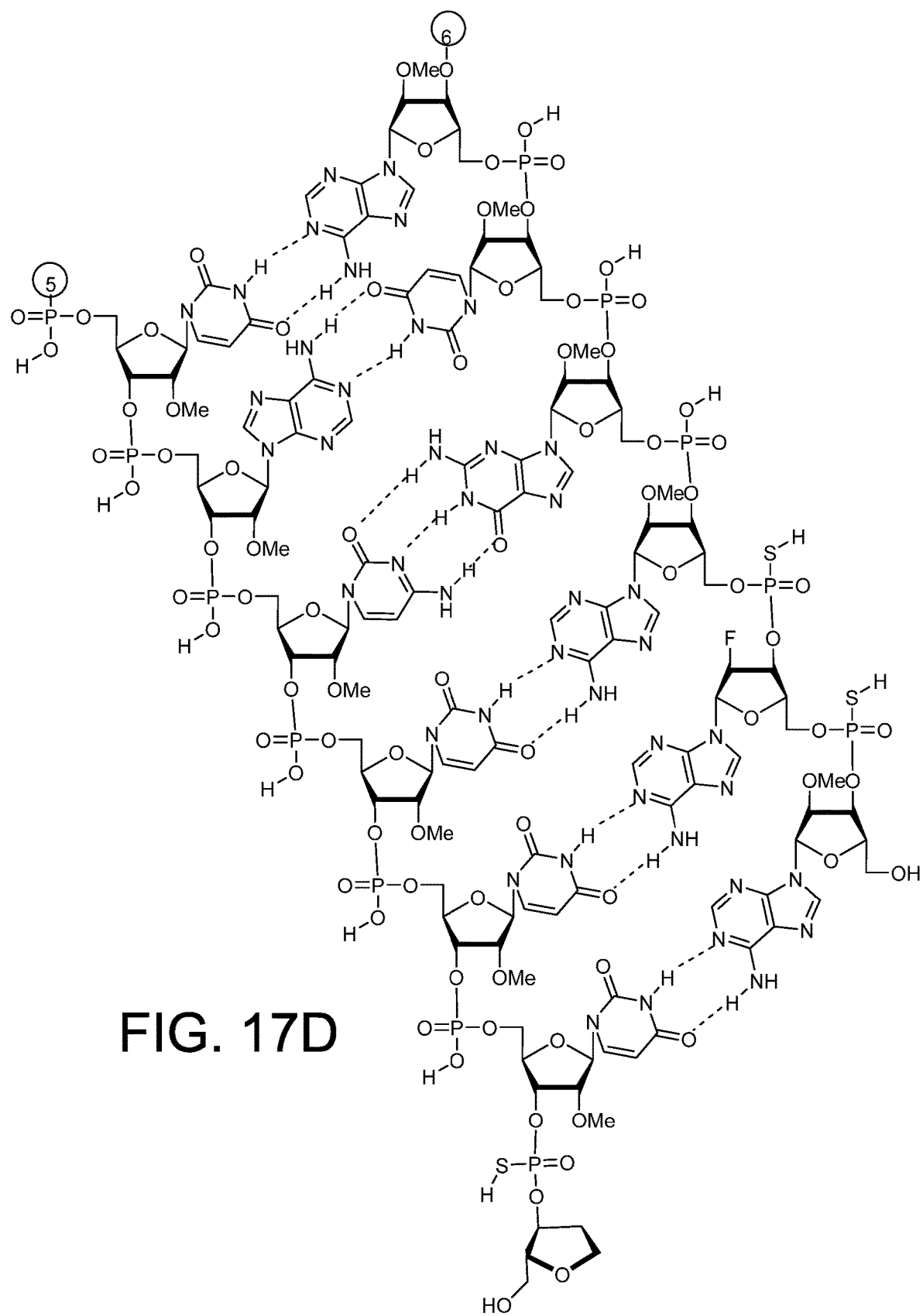
Figure 18A:
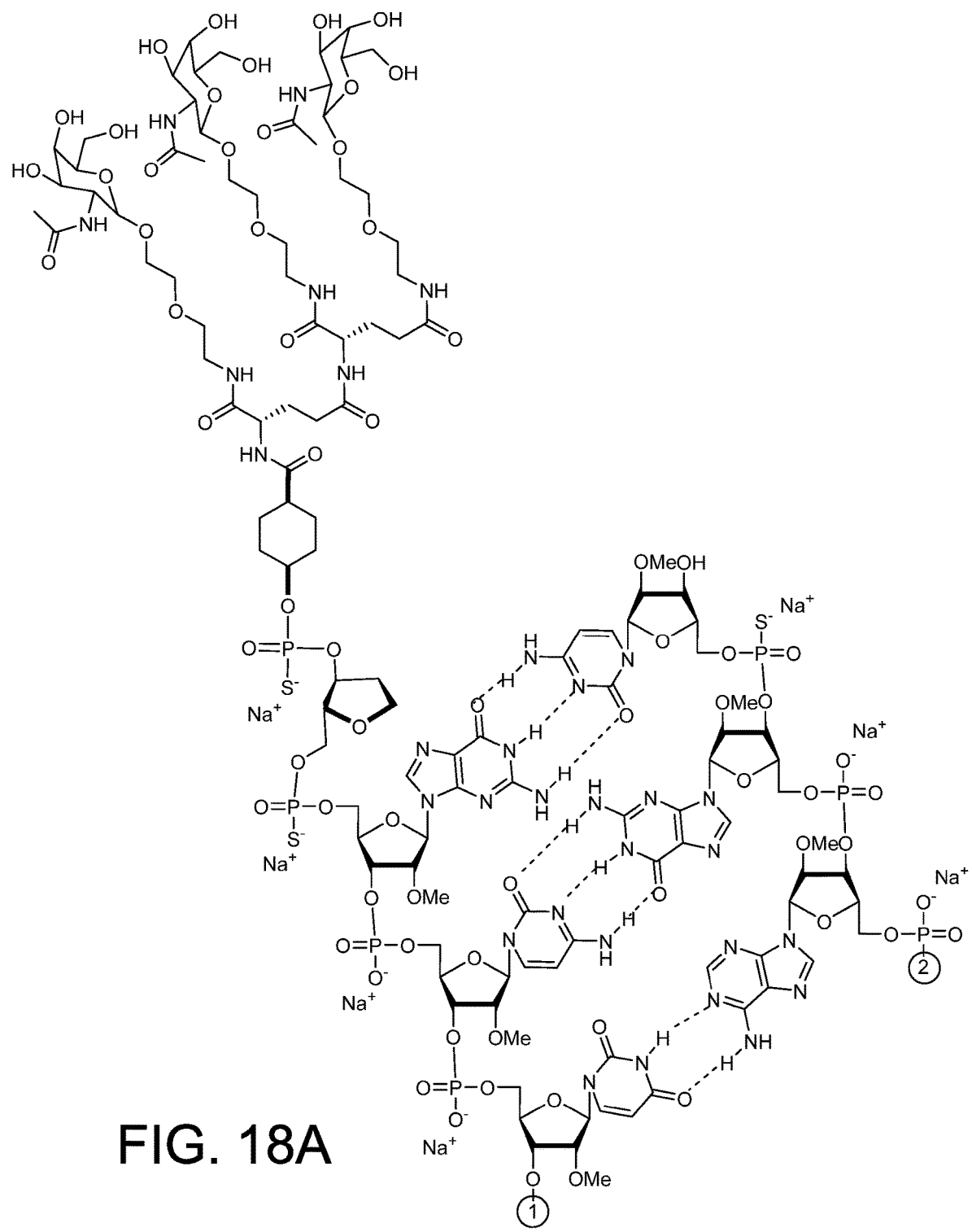
FIG. 18A-18D. Chemical structure representation of CFB RNAi agent AD13126 with the targeting ligand (NAG37)s linked to the 5' end of the sense strand (SEQ ID NOs:983/1077), shown as a sodium salt.
Figure 18B:
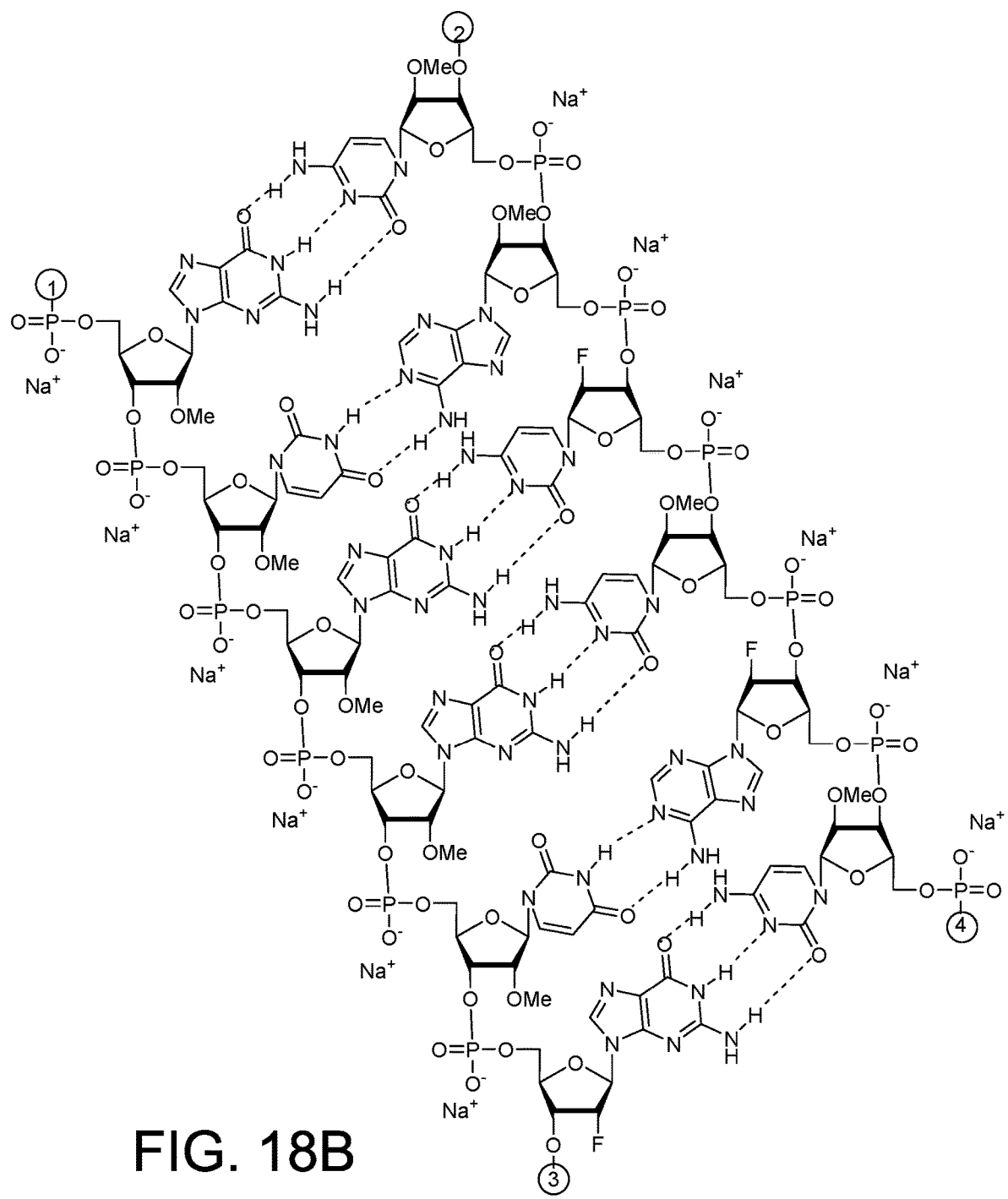
Figure 18C:
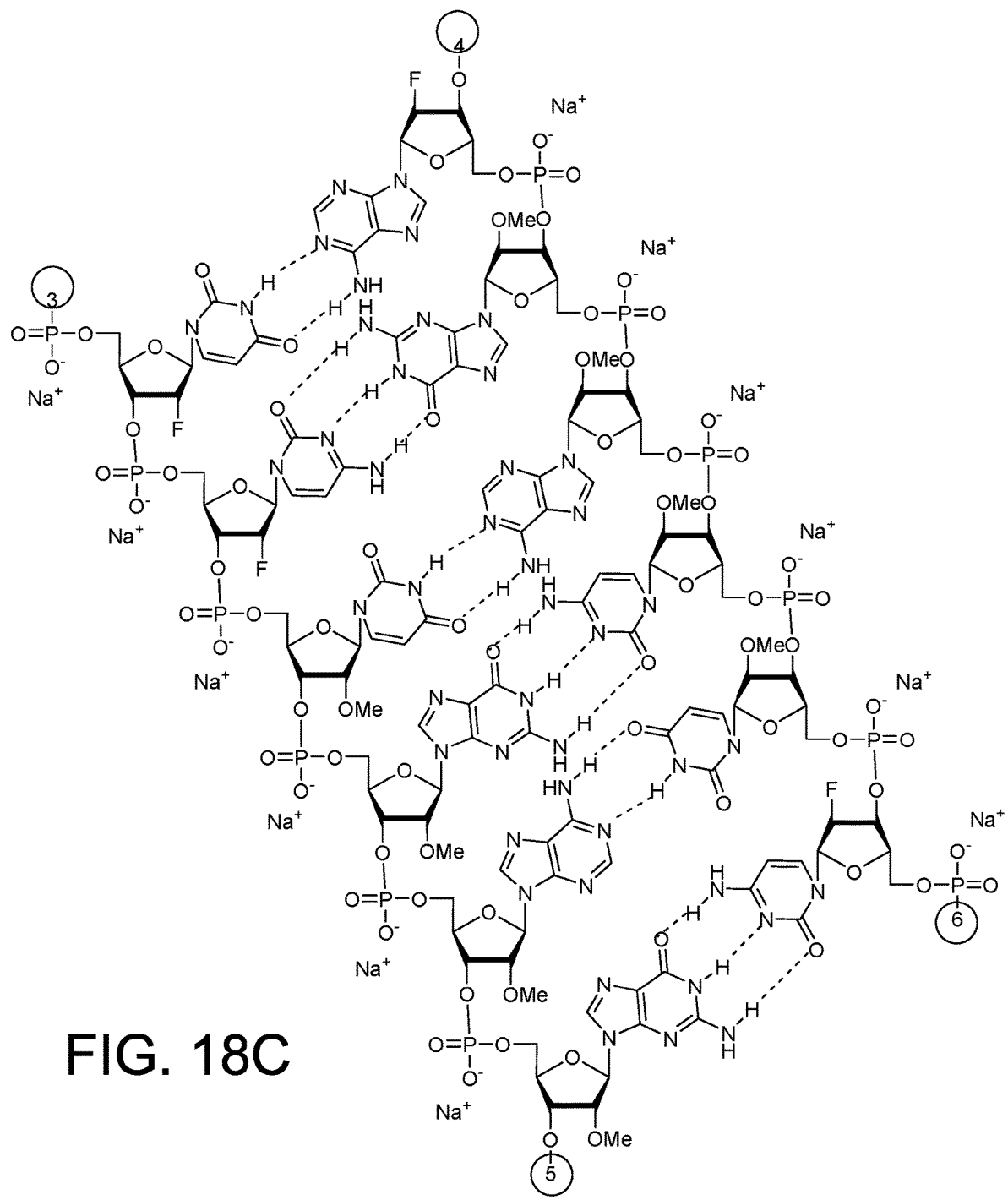
Figure 18D:
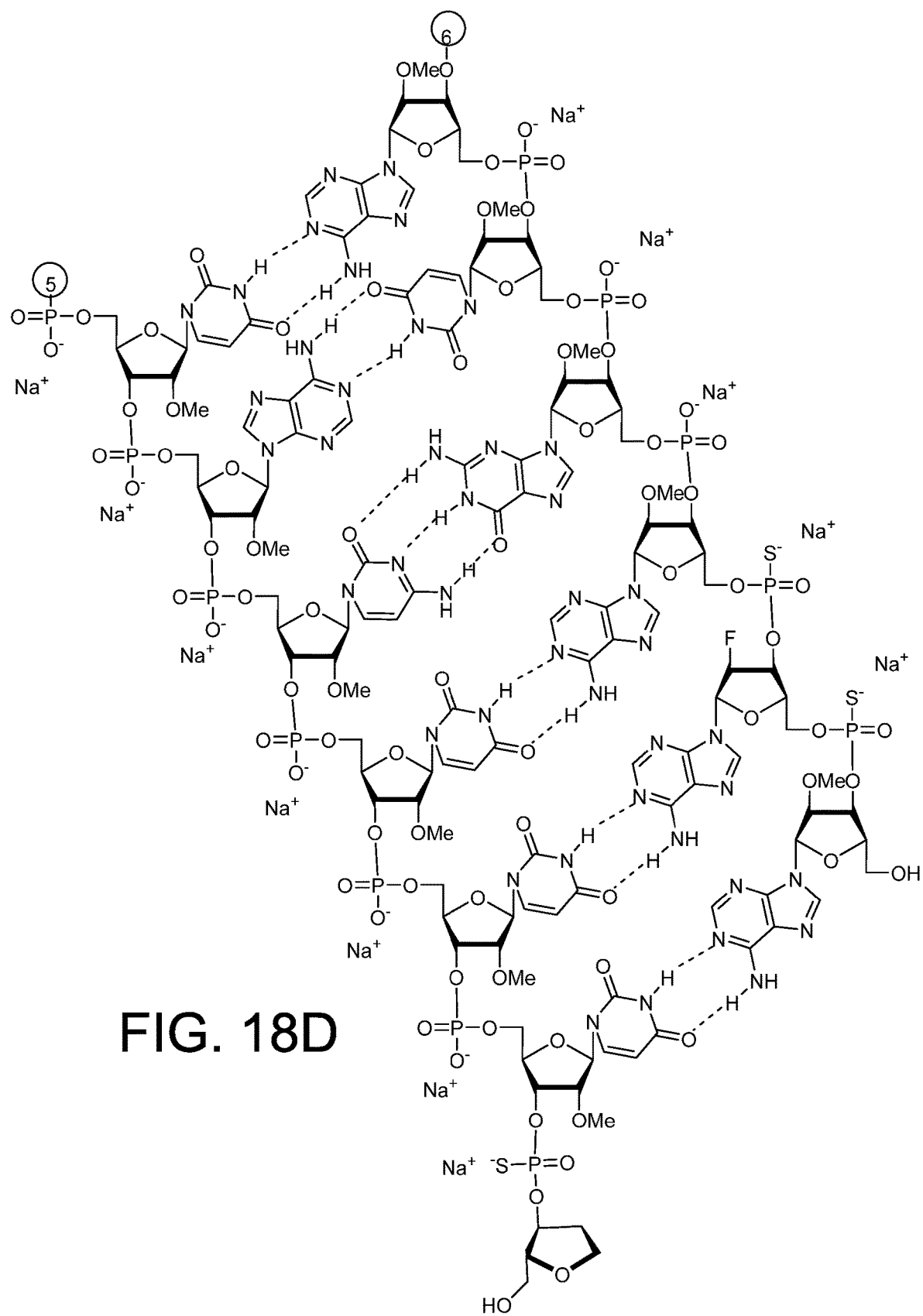
Figure 19A:
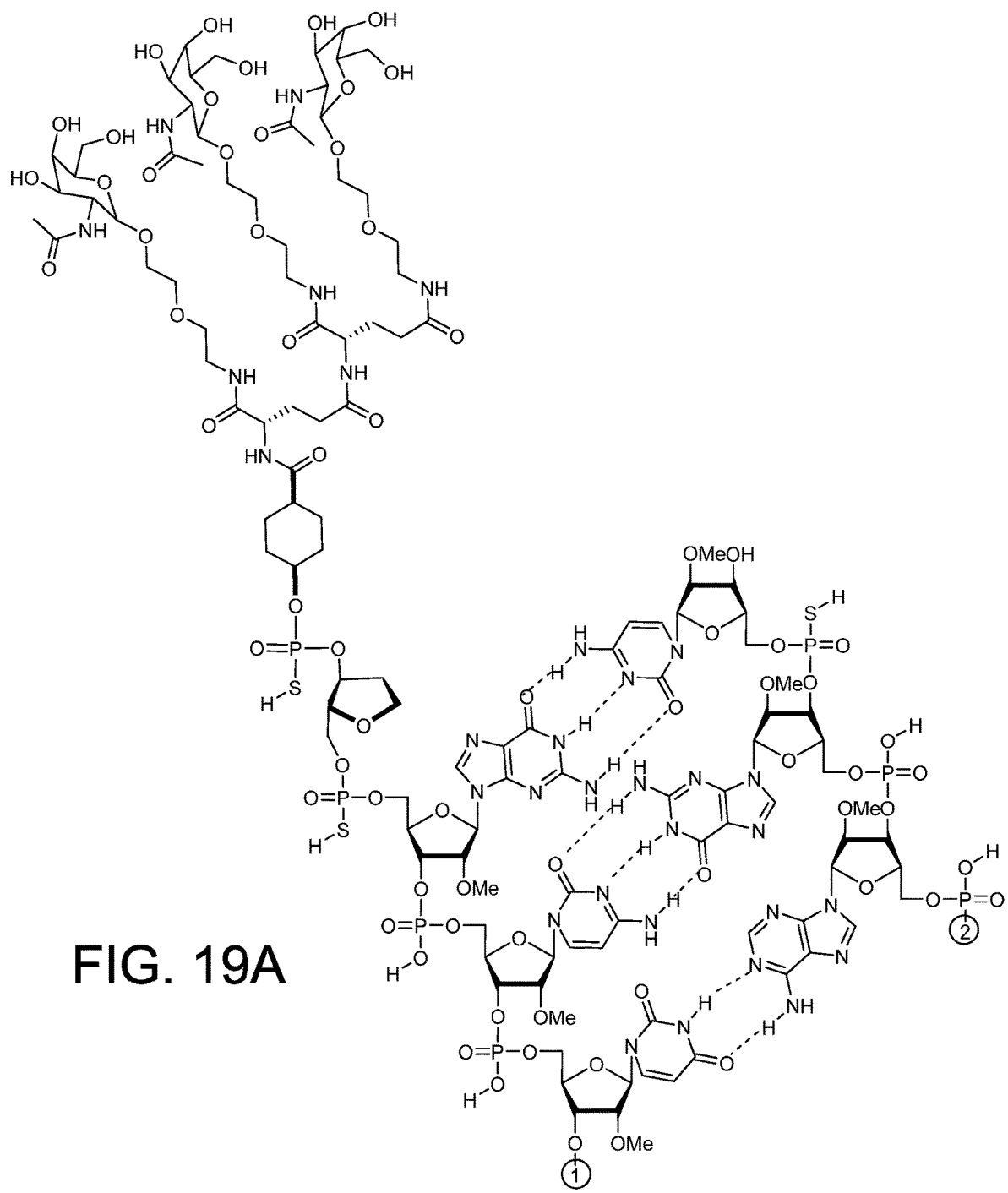
FIG. 19A-19D. Chemical structure representation of CFB RNAi agent AD13933 with the targeting ligand (NAG37)s linked to the 5' end of the sense strand (SEQ ID NOs:1013/1136), shown as a free acid.
Figure 19B:
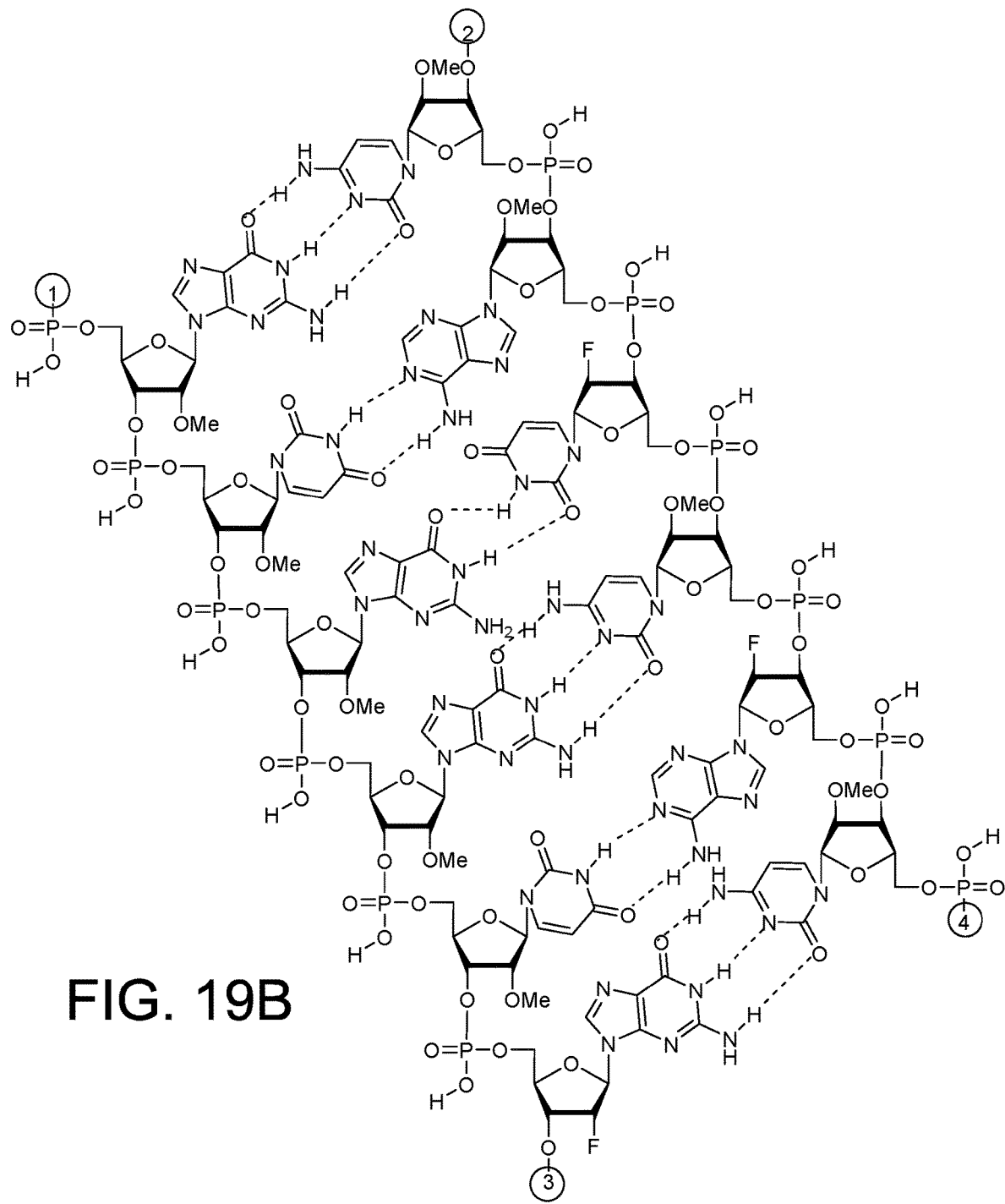
Figure 19C:
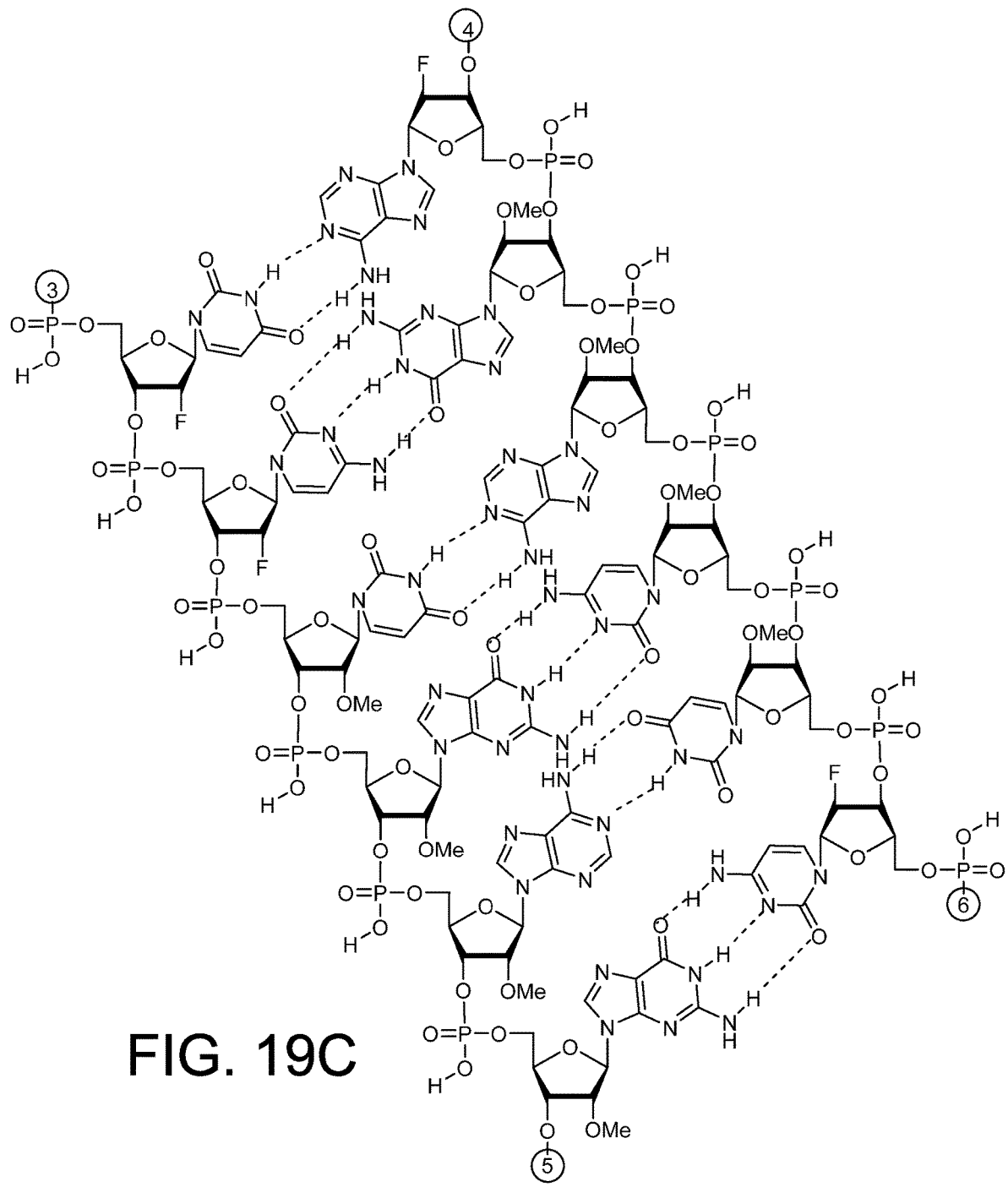
Figure 19D:
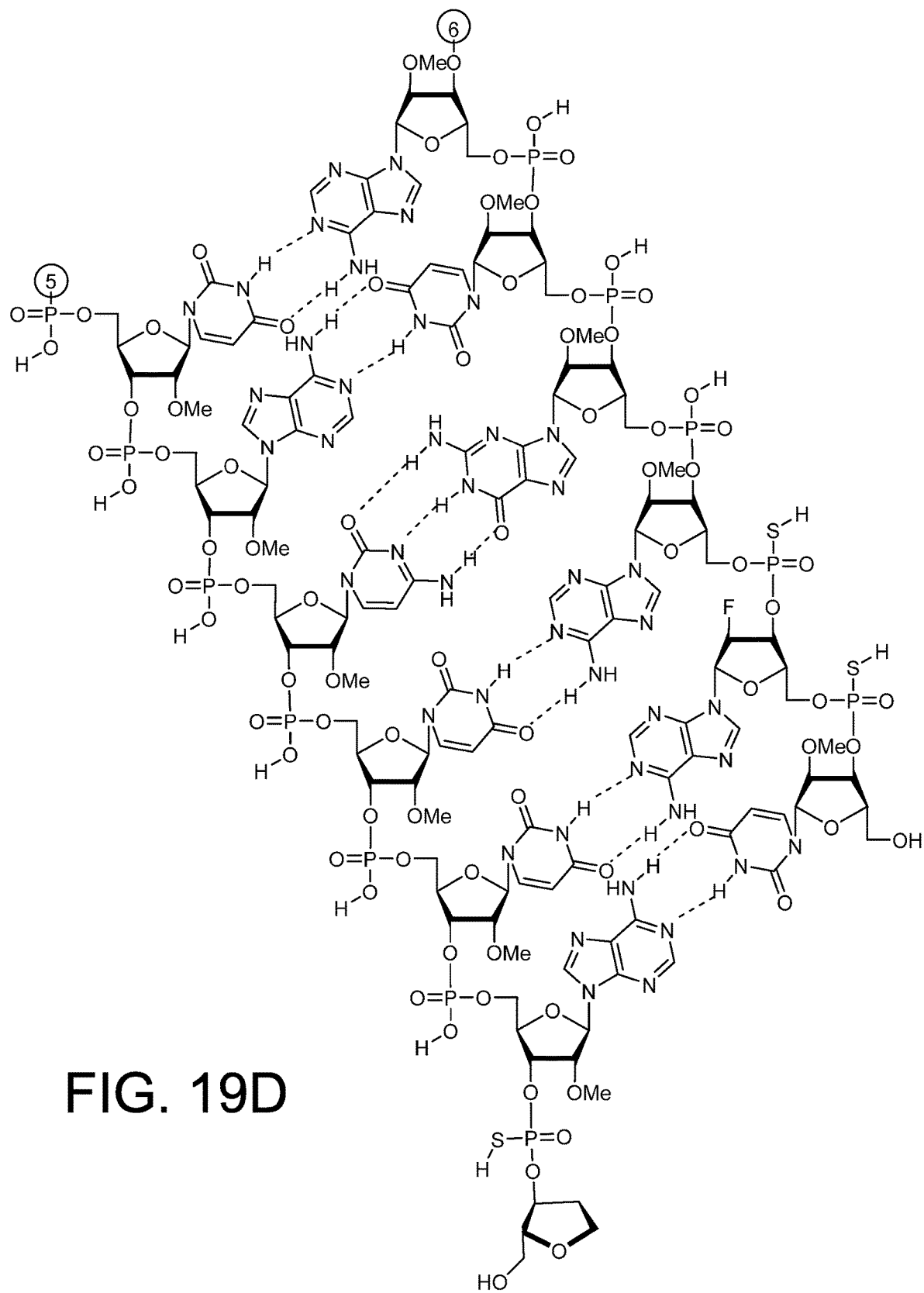
Figure 20A:
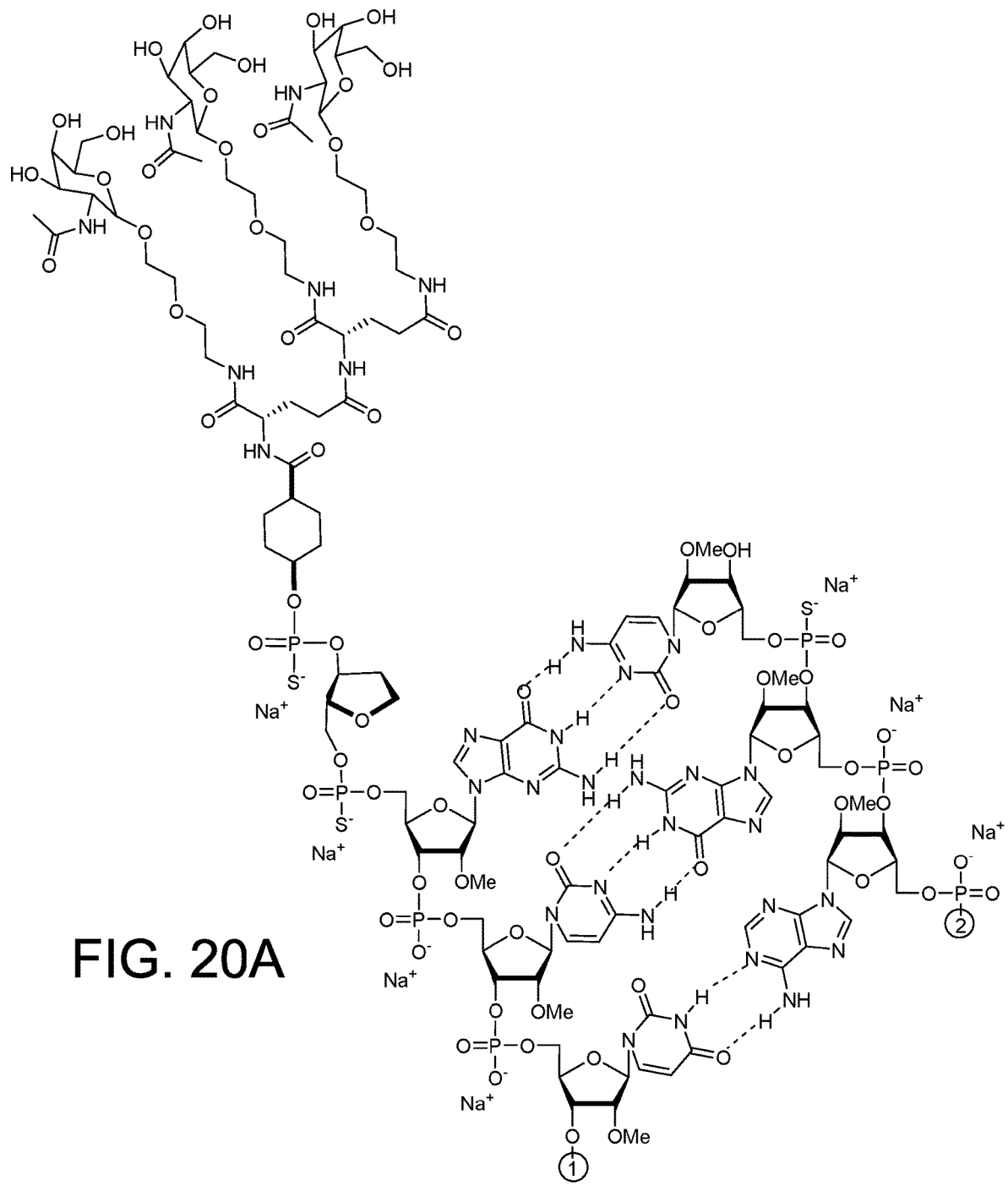
FIG. 20A-20D. Chemical structure representation of CFB RNAi agent AD13933 with the targeting ligand (NAG37)s linked to the 5' end of the sense strand (SEQ ID NOs:1013/1136), shown as a sodium salt.
Figure 20B:
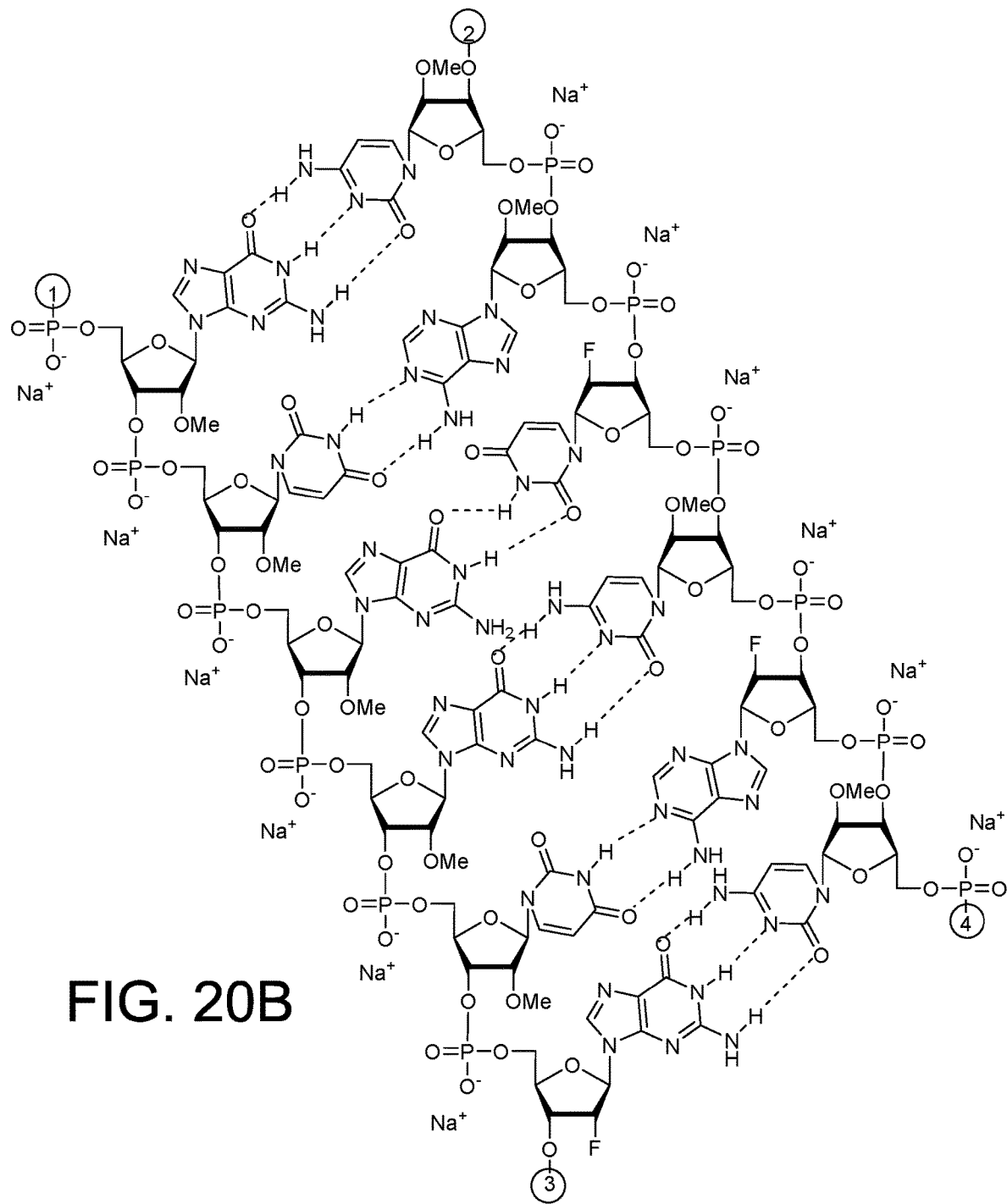
Figure 20C:
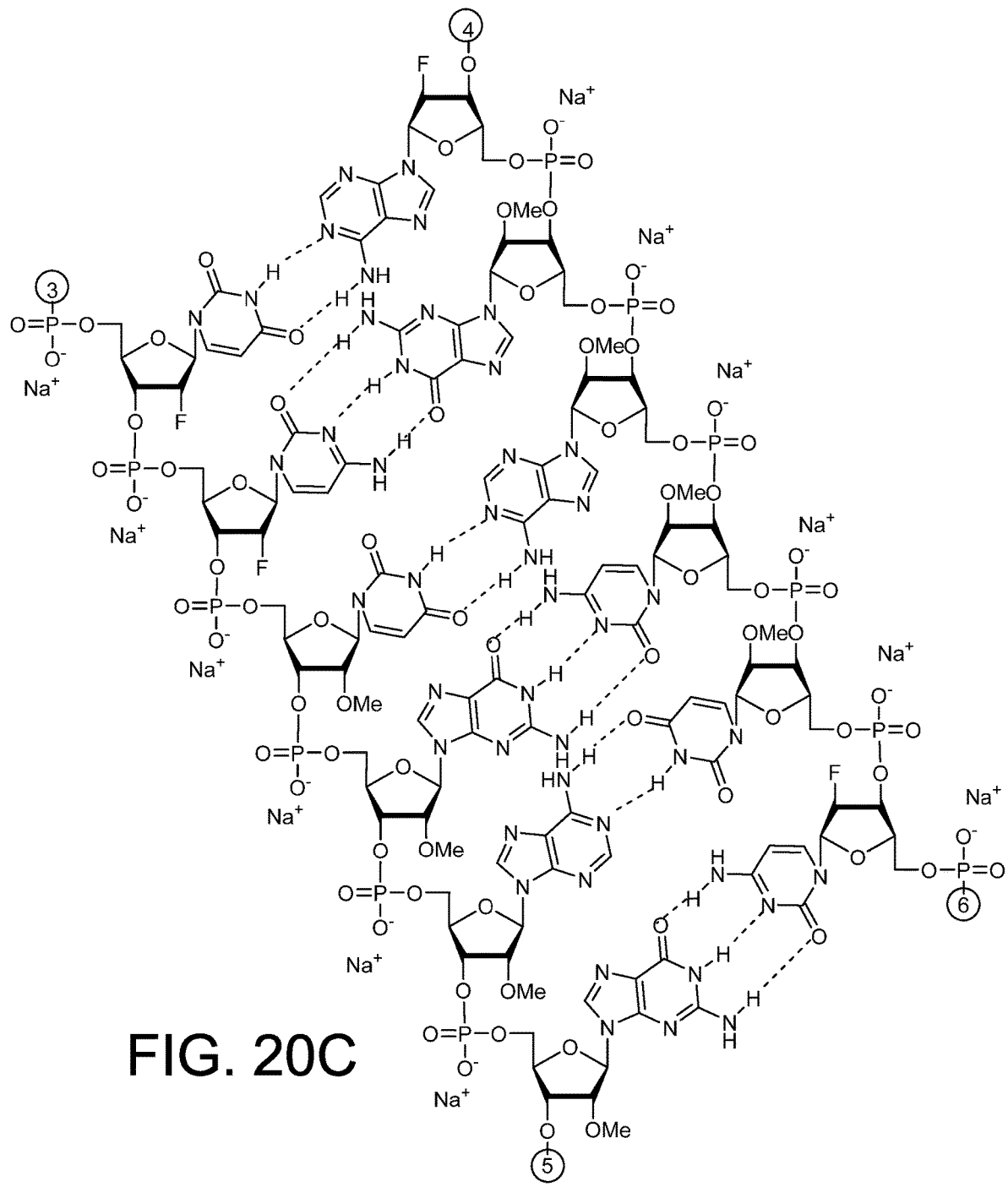
Figure 20D:
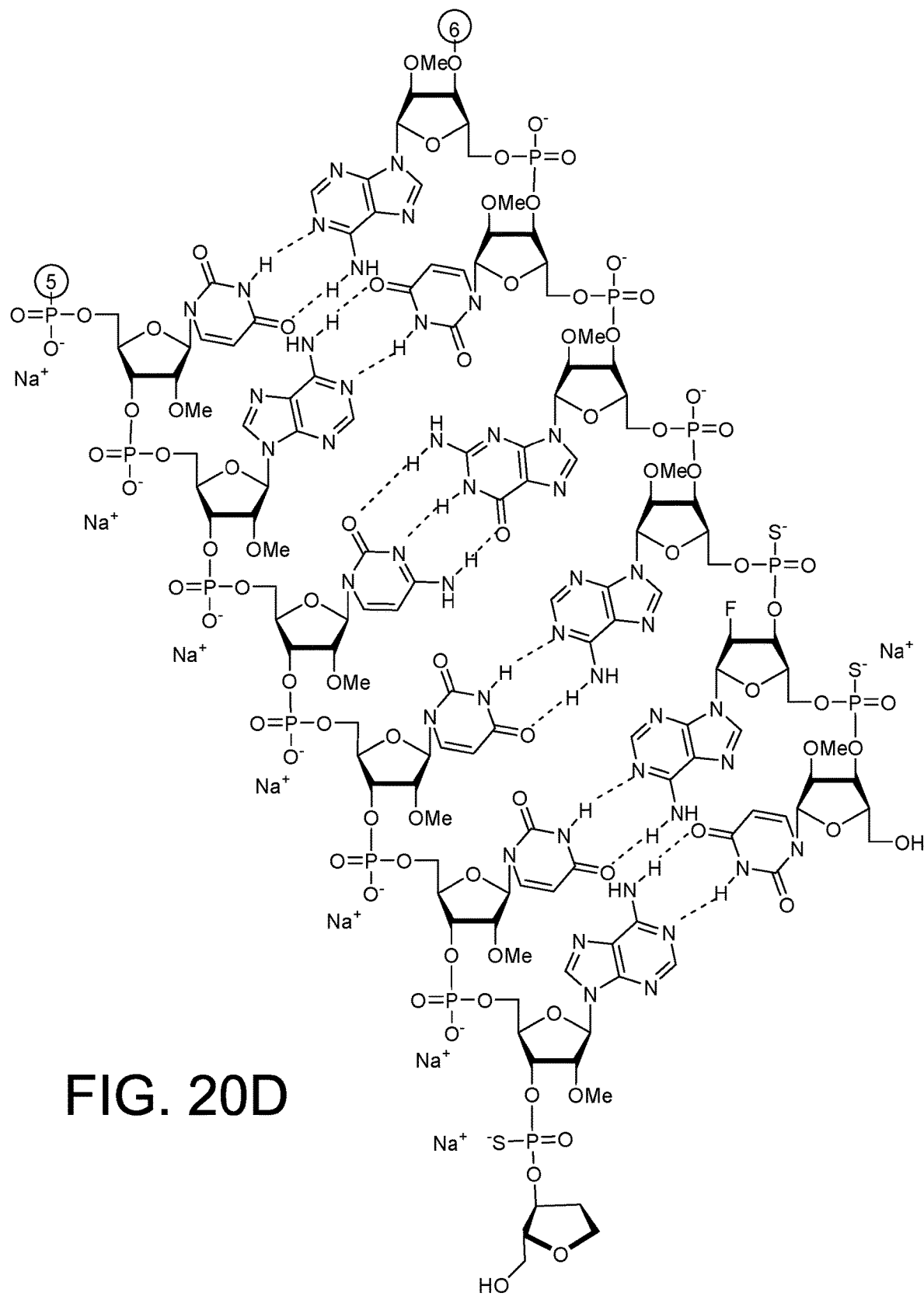
Figure 21A:
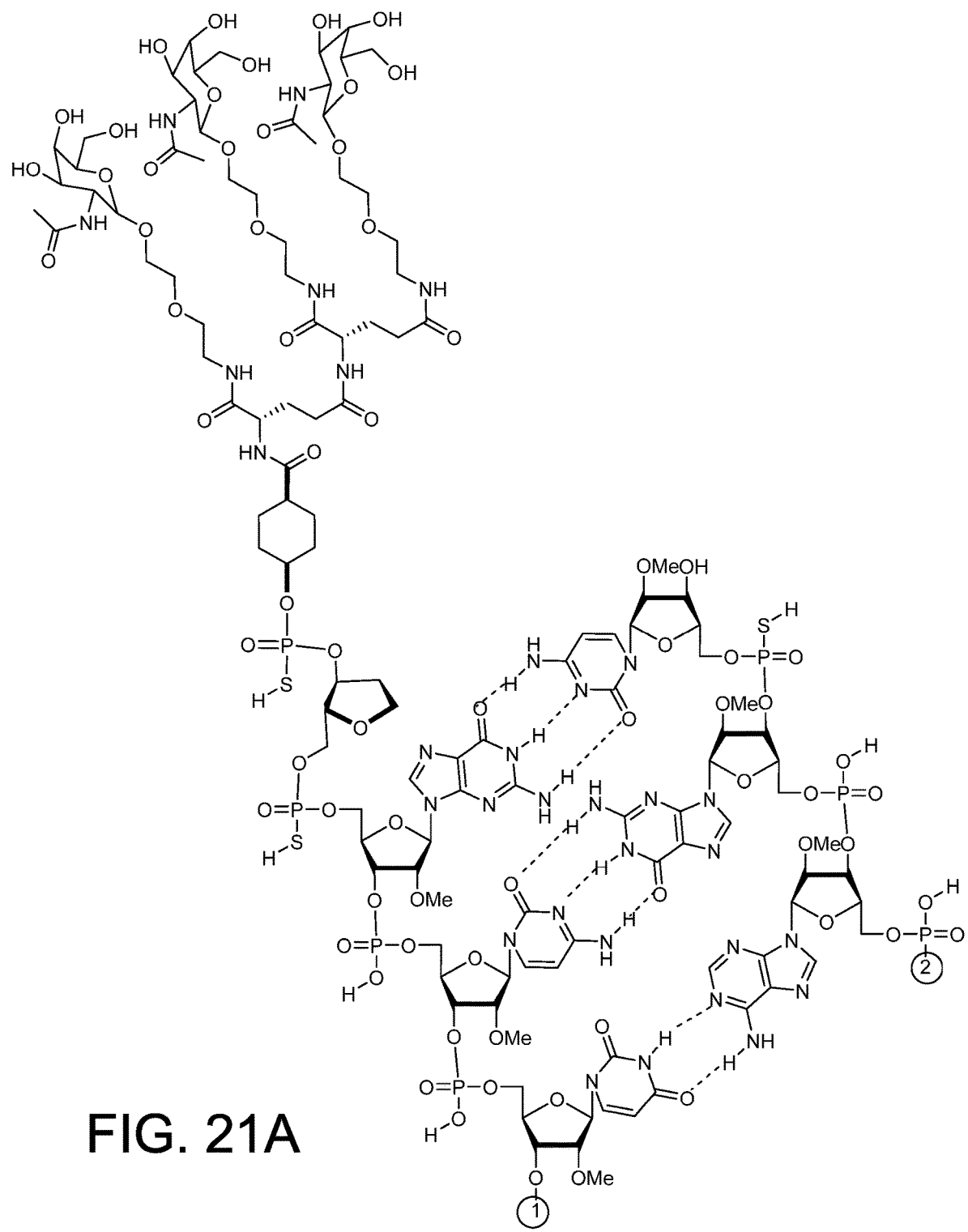
FIG. 21A-21D. Chemical structure representation of CFB RNAi agent AD13935 with the targeting ligand (NAG37)s linked to the 5' end of the sense strand (SEQ ID NOs:994/1149), shown as a free acid.
Figure 21B:
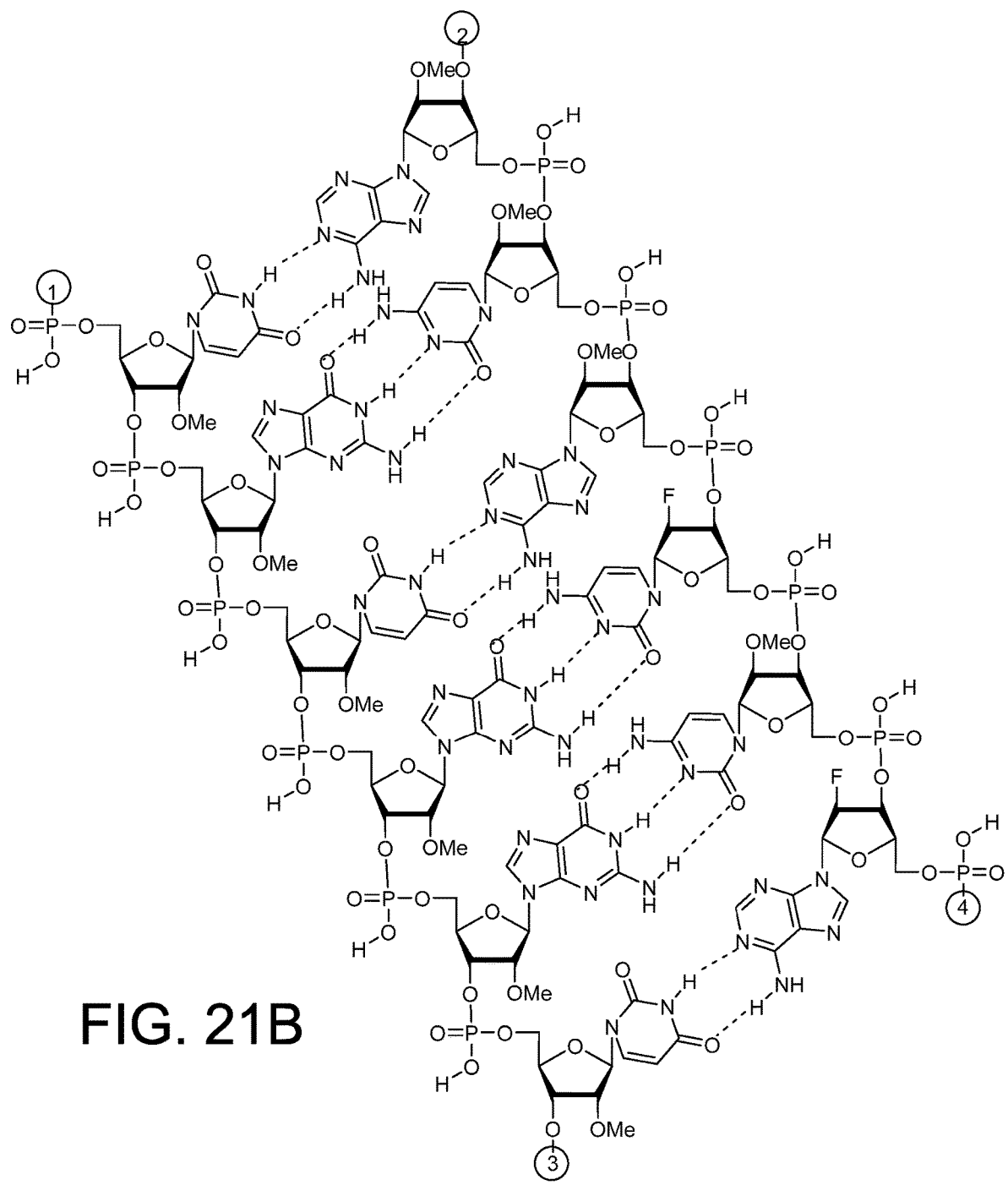
Figure 21C:
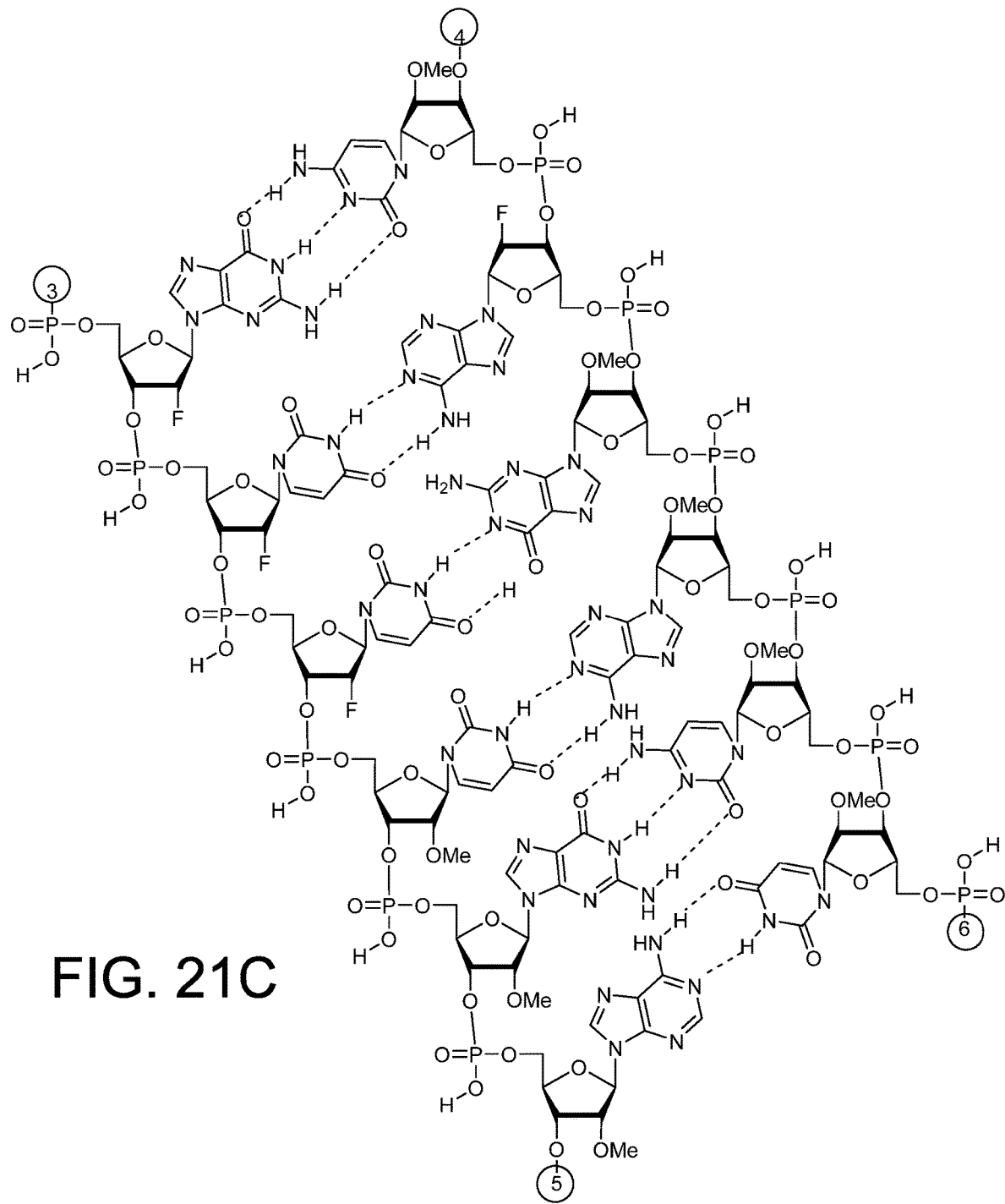
Figure 21D:
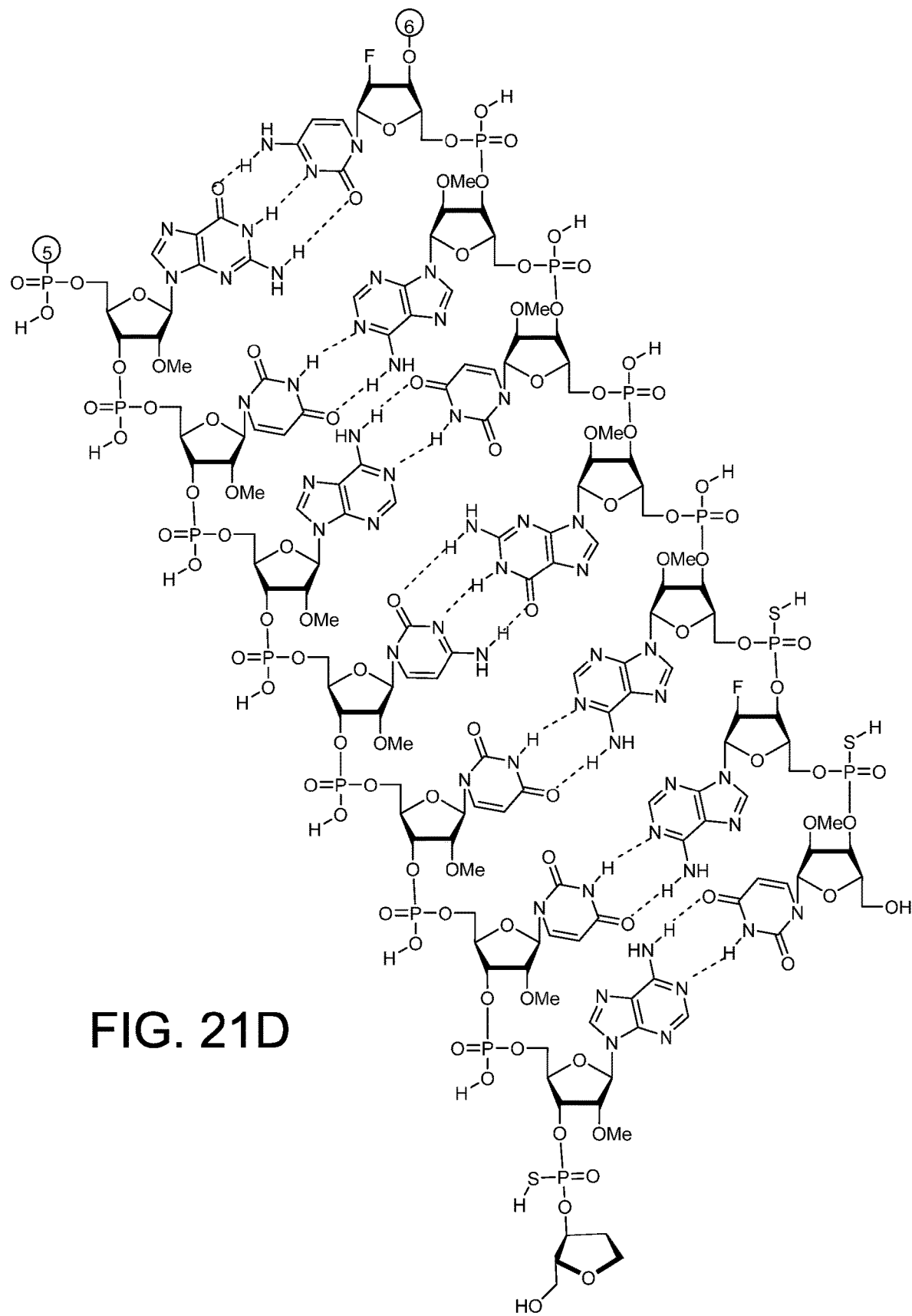
Figure 22A:
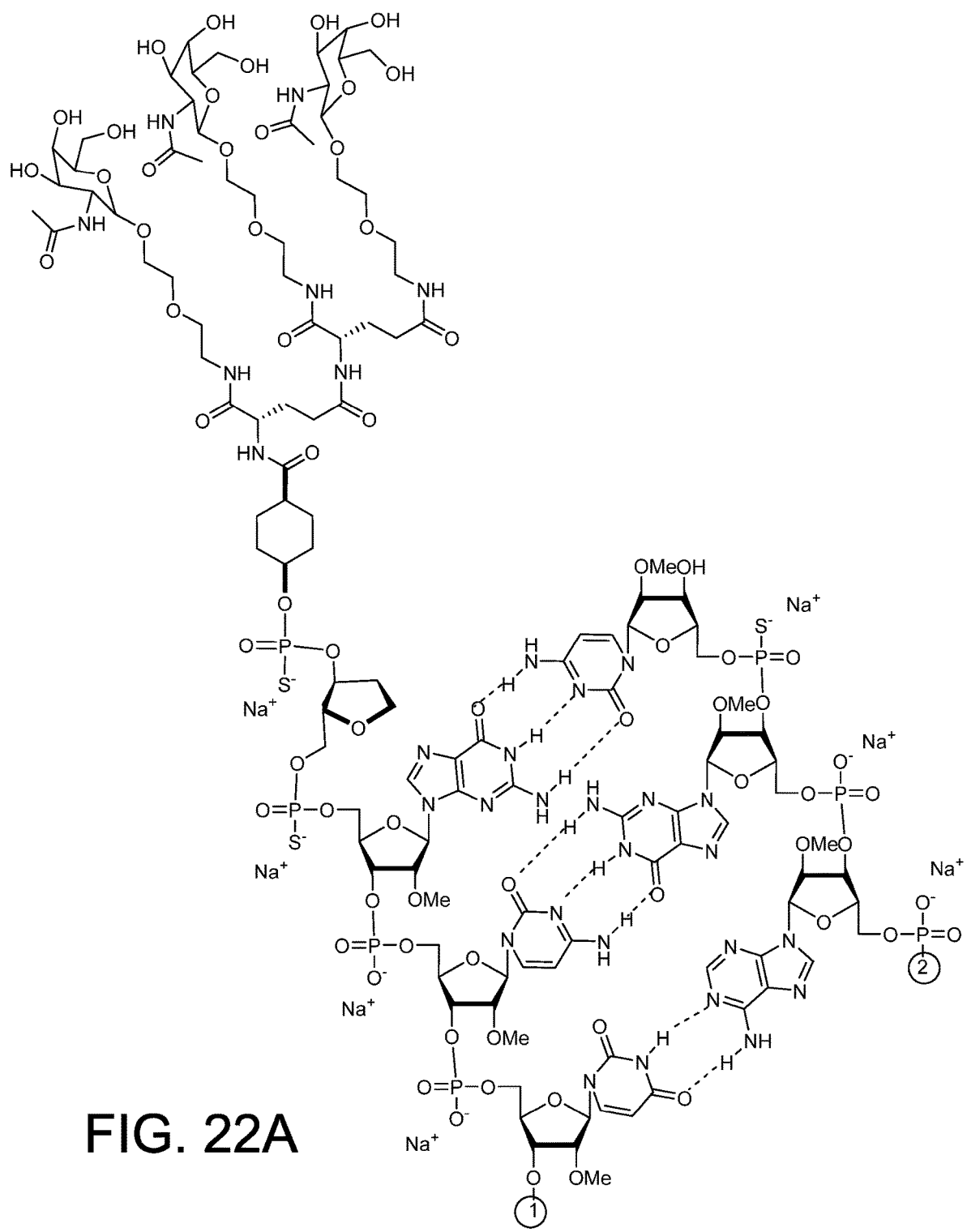
FIG. 22A-22D. Chemical structure representation of CFB RNAi agent AD13935 with the targeting ligand (NAG37)s linked to the 5' end of the sense strand (SEQ ID NOs:994/1149), shown as a sodium salt.
Figure 22B:
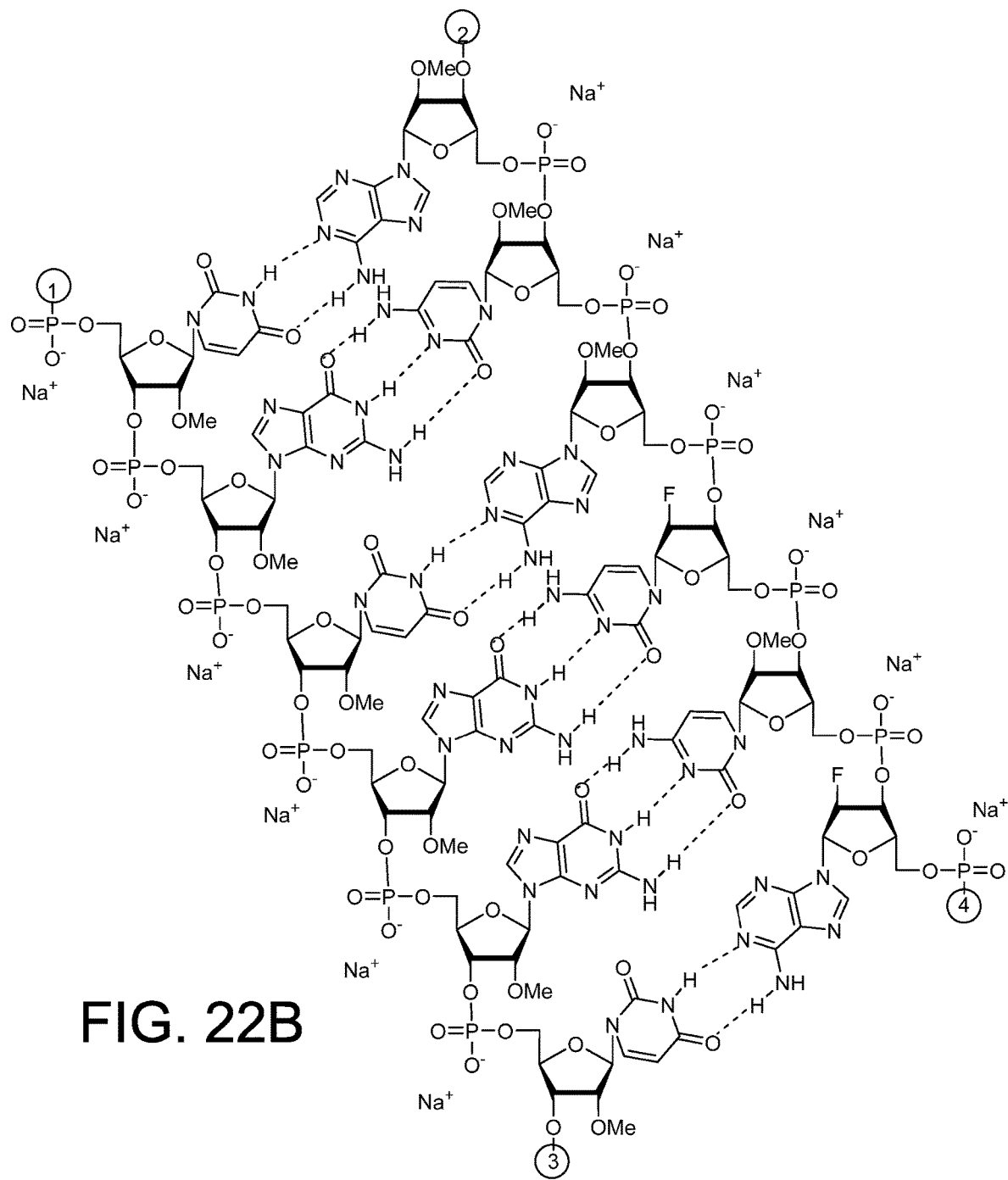
Figure 22C:
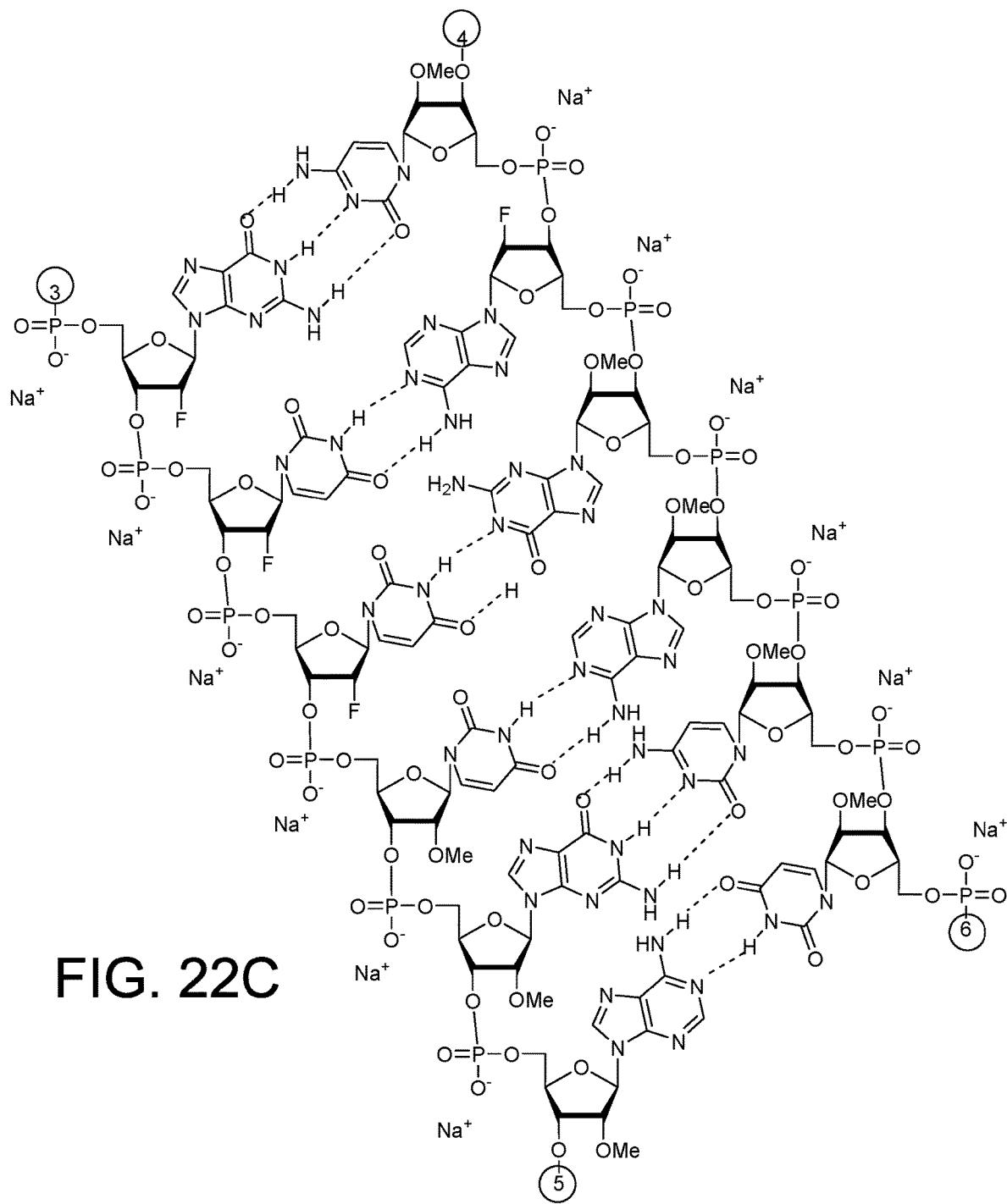
Figure 22D:
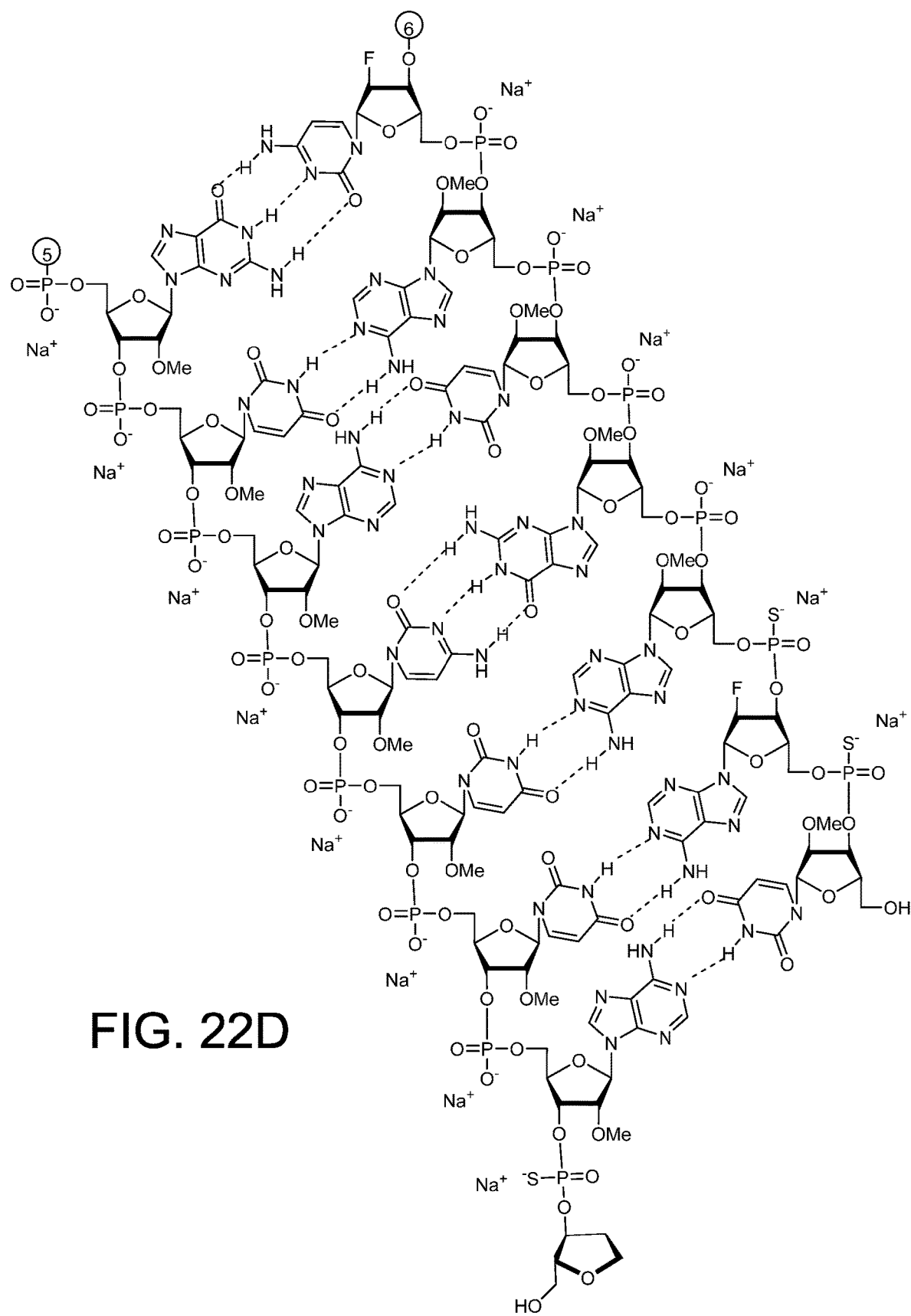

The complement activity affected by treatment of CFB RNAi agent AD13933 was also measured by hemolysis assay and Wieslab® assay (See Example 12 and Example 13 for assay information). CFB RNAi agent AD13933 led to a dose-dependent decrease in complement alternative pathway activity. At nadir, 4.5 mg/kg of CFB RNAi agent AD13933 caused over 70% (AP50 of hemolysis, FIG. 11)) and 90% (Wieslab® AP assay, FIG. 12)) of alternative pathway activity loss. On the other hand, classical pathway activity measured by CH50 of hemolysis (FIG. 13) and Wieslab® CP (classical pathway) assay (FIG. 14) was not changed, again confirming that the CFB inhibition caused by CFB RNAi agent AD13933 does not impact the classical pathway.

Results of this study suggest that CFB RNAi agent AD13933 effectively silences CFB gene expression. Repeated dosing resulted in additional pharmacodynamic effects. Not only was CFB protein in serum significantly decreased by the treatment of CFB RNAi agent AD13933 in a dose-related manner, but the CFB-related function of complement alternative pathway activity was dramatically compromised in correlation with the CFB reductions.

Example 17. Toxicological Assessments of CFB RNAi Agents

The nonclinical safety profile of CFB RNAi agent AD13933 was evaluated through a standard series of in vitro and in vivo studies. Results of the non-GLP in vitro studies demonstrated that there is little potential for induction of the innate immune system (cytokine and complement activation), mitochondrial toxicity/cytotoxicity, or spontaneous platelet aggregation. CFB RNAi agent AD13933 was also shown to be free of adverse effects on the central nervous, respiratory, or cardiovascular systems, as demonstrated by the results of safety pharmacology assessments.

Repeat-dose toxicology studies using subcutaneous administration at one dose every four weeks were conducted to evaluate the general toxicity potential of AD13933. A summary of study NOAELs is provided in Table.

TABLE 31

Summary of Study No-Observed-Adverse-Effect Levels

| Study Type | NOAEL | |
|---|---|---|
| | Rat | Monkey |
| General Toxicology, three Q4W doses-short term | 30 mg/kg | 300 mg/kg |

Abbreviations: NOAEL = no-observed-adverse-effect level; Q4W = every 4 weeks.

The microscopic findings in the rat liver and kidney and monkey injection site and lymph nodes were suggestive of uptake and clearance of CFB RNAi agent AD13933, similar to those described for other subcutaneously administered N-acetyl-galactosamine siRNA drugs. While microscopic findings were also noted in the adrenal gland and pancreas of rats, they were not considered adverse. The incidence and severity of hepatocellular karyocytomegaly noted in rats administered ≥100 mg/kg ADS-020 was used to assign a NOAEL of 30 mg/kg, however, these findings consisted without clinical pathology correlates and were not associated with apparent adverse effects on organ function or the general health of the animals.

Further, an off-target analysis was conducted on the nucleotide sequence of CFB RNAi agent AD13933, and indicated that CFB RNAi agent AD13933 is an RNAi agent highly specific to CFB mRNA in human, with very low potential of causing off-target gene silencing particularly at clinically relevant doses.

Collectively, the results of the in vitro and in vivo nonclinical safety studies conducted support that CFB RNAi agent AD13933 is suitably safe for clinical development in humans. The toxicological effects observed in the animal studies are not considered to pose a substantial risk to human safety since they occurred at a dose level substantially greater than those intended to be used in clinical studies.

Other Embodiments

It is to be understood that while the invention has been described in conjunction with the detailed description thereof, the foregoing description is intended to illustrate and not limit the scope of the invention, which is defined by the scope of the appended claims. Other aspects, advantages, and modifications are within the scope of the following claims.

SEQUENCE LISTING (1439 sequences)

SEQ ID NO: 1 - RNA, 2476 nt, Homo sapiens
  source 1..2476: mol_type = mRNA
gggaagggaatgtgaccaggtctaggtctggagtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggaggtgtgaccaccactccatggtctttggcccggccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagagcaatccactgtccaagaccacacgacttcgagaacggggaatactggccccggtctccctactacaatgtgagtgatgagatctctttccactgctatgacggttacactctccggggctctgccaatcgcacctgccaagtgaatggccgatggagtgggcagacagcgatctgtgacaacggagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaagactccttcatgtacgacacccctcaagaggtggccgaagctttcctgtcttccctgacagagaccatagaaggagtcgatgctgaggatgggcacggcccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaagaccacaagttgaagtcagggactaacaccaagaaggccctccaggcagtgtacagcatgatgagctggccagatgacgtccctcctgaaggctggaaccgcacccgccatgtcatcatcctcatgactgatggattgcacaacatgggcggggacccaattactgtcattgatgagatccgggacttgctatacattggcaaggatcgcaaaaacccaagggaggattatctggatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcgatgaaagccagtctctgagtctctgtggcatggtttgggaacacaggaagggtaccgattaccacaagcaaccatggcaggccaagatctcagtcattcgcccttcaaagggacacgagagctgtatgggggctgtggtgtctgagtactttgtgctgacagcagcacattgtttcactgtggatgacaaggaacactcaatcaaggtcagcgtaggaggggagaagcgggacctggagatagaagtagtcctatttcaccccaactacaacattaatgggaaaaaagaagcaggaattcctgaattttatgactatgacgttgccctgatcaagctcaagaataagctgaaatatggccagactatcaggcccatttgtctcccctgcaccgagggaacaactcgagctttgaggcttcctccaactaccacttgccagcaacaaaaggaagagctgctccctgcacaggatatcaaagctctgtttgtgtctgaggaggagaaaaagctgactcggaaggaggtctacatcaagaatggggataagaaaggcagctgtgagagagatgctcaatatgccccaggctatgacaaagtcaaggacatctcagaggtggtcacccctcggttcctttgtactggaggagtgagtccctatgctgaccccaatacttgcagaggtgattctggcggccccttgatagttcacaagagaagtcgtttcattcaagttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggtttcctgctggacaggggcgtgggattgaattaaaacagctgcgacaaca

SEQ ID NO: 2 - RNA, 19 nt, synthetic construct
  source 1..19: mol_type = other RNA
cgtgtgtccttctggcttc

SEQ ID NO: 3 - RNA, 19 nt, synthetic construct
  source 1..19: mol_type = other RNA
tgagtgatgagatctcttt

SEQ ID NO: 4 - RNA, 19 nt, synthetic construct
  source 1..19: mol_type = other RNA
agtgatgagatctctttcc

SEQ ID NO: 5 - RNA, 19 nt, synthetic construct
  source 1..19: mol_type = other RNA
ctgctatgacggttacact

SEQ ID NO: 6 - RNA, 19 nt, synthetic construct
  source 1..19: mol_type = other RNA
gccaagactccttcatgta

SEQ ID NO: 7 - RNA, 19 nt, synthetic construct
  source 1..19: mol_type = other RNA
aagactccttcatgtacga

SEQ ID NO: 8 - RNA, 19 nt, synthetic construct
  source 1..19: mol_type = other RNA
actccttcatgtacgacac

SEQ ID NO: 9 - RNA, 19 nt, synthetic construct
  source 1..19: mol_type = other RNA
gaccatagaaggagtcgat

SEQ ID NO: 10 - RNA, 19 nt, synthetic construct
  source 1..19: mol_type = other RNA
tccatgaacatctacctgg

SEQ ID NO: 11 - RNA, 19 nt, synthetic construct
  source 1..19: mol_type = other RNA
acatctacctggtgctaga

SEQ ID NO: 12 - RNA, 19 nt, synthetic construct
  source 1..19: mol_type = other RNA
atctacctggtgctagatg

SEQ ID NO: 13 - RNA, 19 nt, synthetic construct
  source 1..19: mol_type = other RNA
tctacctggtgctagatgg

SEQ ID NO: 14 - RNA, 19 nt, synthetic construct
  source 1..19: mol_type = other RNA
ctacctggtgctagatgga

SEQ ID NO: 15 - RNA, 19 nt, synthetic construct
  source 1..19: mol_type = other RNA
tacctggtgctagatggat

SEQ ID NO: 16 - RNA, 19 nt, synthetic construct
  source 1..19: mol_type = other RNA
cctggtgctagatggatca

SEQ ID NO: 17 - RNA, 19 nt, synthetic construct
  source 1..19: mol_type = other RNA
gtgctagatggatcagaca

SEQ ID NO: 18 - RNA, 19 nt, synthetic construct
  source 1..19: mol_type = other RNA
tagatggatcagacagcat

SEQ ID NO: 19 - RNA, 19 nt, synthetic construct
  source 1..19: mol_type = other RNA
ggatcagacagcattgggg

SEQ ID NO: 20 - RNA, 19 nt, synthetic construct
  source 1..19: mol_type = other RNA
gccaaaaagtgtctagtca

SEQ ID NO: 21 - RNA, 19 nt, synthetic construct
  source 1..19: mol_type = other RNA
caaaaagtgtctagtcaac

SEQ ID NO: 22 - RNA, 19 nt, synthetic construct
  source 1..19: mol_type = other RNA
aaaagtgtctagtcaactt

SEQ ID NO: 23 - RNA, 19 nt, synthetic construct
  source 1..19: mol_type = other RNA
gaaggtggcaagttatggt

SEQ ID NO: 24 - RNA, 19 nt, synthetic construct
  source 1..19: mol_type = other RNA
aaggtggcaagttatggtg

SEQ ID NO: 25 - RNA, 19 nt, synthetic construct
  source 1..19: mol_type = other RNA
gttatggtgtgaagccaag

SEQ ID NO: 26 - RNA, 19 nt, synthetic construct
  source 1..19: mol_type = other RNA
gcagtgtacagcatgatga

SEQ ID NO: 27 - RNA, 19 nt, synthetic construct
  source 1..19: mol_type = other RNA
gatggattgcacaacatgg

SEQ ID NO: 28 - RNA, 19 nt, synthetic construct
  source 1..19: mol_type = other RNA
acccaattactgtcattga

SEQ ID NO: 29 - RNA, 19 nt, synthetic construct
  source 1..19: mol_type = other RNA
cccaattactgtcattgat

SEQ ID NO: 30 - RNA, 19 nt, synthetic construct
  source 1..19: mol_type = other RNA
caattactgtcattgatga

SEQ ID NO: 31 - RNA, 19 nt, synthetic construct
  source 1..19: mol_type = other RNA
ctgtcattgatgagatccg

SEQ ID NO: 32 - RNA, 19 nt, synthetic construct
  source 1..19: mol_type = other RNA
aggattatctggatgtcta

SEQ ID NO: 33 - RNA, 19 nt, synthetic construct
  source 1..19: mol_type = other RNA
tctggatgtctatgtgttt

SEQ ID NO: 34 - RNA, 19 nt, synthetic construct
  source 1..19: mol_type = other RNA
tggatgtctatgtgtttgg

SEQ ID NO: 35 - RNA, 19 nt, synthetic construct
  source 1..19: mol_type = other RNA
accaagtgaacatcaatgc

SEQ ID NO: 36 - RNA, 19 nt, synthetic construct
  source 1..19: mol_type = other RNA
aagtgaacatcaatgcttt

SEQ ID NO: 37 - RNA, 19 nt, synthetic construct
  source 1..19: mol_type = other RNA
gaacatcaatgctttggct

SEQ ID NO: 38 - RNA, 19 nt, synthetic construct
  source 1..19: mol_type = other RNA
acatcaatgctttggcttc

SEQ ID NO: 39 - RNA, 19 nt, synthetic construct
  source 1..19: mol_type = other RNA
agaaagacaatgagcaaca

SEQ ID NO: 40 - RNA, 19 nt, synthetic construct
  source 1..19: mol_type = other RNA
aagacaatgagcaacatgt

SEQ ID NO: 41 - RNA, 19 nt, synthetic construct
  source 1..19: mol_type = other RNA
tctgagtctctgtggcatg

SEQ ID NO: 42 - RNA, 19 nt, synthetic construct
  source 1..19: mol_type = other RNA
taccgattaccacaagcaa

SEQ ID NO: 43 - RNA, 19 nt, synthetic construct
  source 1..19: mol_type = other RNA
ccgattaccacaagcaacc

SEQ ID NO: 44 - RNA, 19 nt, synthetic construct
  source 1..19: mol_type = other RNA
tggcaggccaagatctcag

SEQ ID NO: 45 - RNA, 19 nt, synthetic construct
  source 1..19: mol_type = other RNA
tgtggtgtctgagtacttt

SEQ ID NO: 46 - RNA, 19 nt, synthetic construct
  source 1..19: mol_type = other RNA
tgtctgagtactttgtgct

SEQ ID NO: 47 - RNA, 19 nt, synthetic construct
  source 1..19: mol_type = other RNA
gtctgagtactttgtgctg

SEQ ID NO: 48 - RNA, 19 nt, synthetic construct
  source 1..19: mol_type = other RNA
tgacagcagcacattgttt

SEQ ID NO: 49 - RNA, 19 nt, synthetic construct
  source 1..19: mol_type = other RNA
gacgttgccctgatcaagc

SEQ ID NO: 50 - RNA, 19 nt, synthetic construct
  source 1..19: mol_type = other RNA
acgttgccctgatcaagct

SEQ ID NO: 51 - RNA, 19 nt, synthetic construct
  source 1..19: mol_type = other RNA
tttcattcaagttggtgta

SEQ ID NO: 52 - RNA, 19 nt, synthetic construct
  source 1..19: mol_type = other RNA
aatcagctggggagtagtg

SEQ ID NO: 53 - RNA, 19 nt, synthetic construct
  source 1..19: mol_type = other RNA
tcagctggggagtagtgga

SEQ ID NO: 54 - RNA, 19 nt, synthetic construct
  source 1..19: mol_type = other RNA
ctggggagtagtggatgtc

SEQ ID NO: 55 - RNA, 19 nt, synthetic construct
  source 1..19: mol_type = other RNA
ggggagtagtggatgtctg

SEQ ID NO: 56 - RNA, 19 nt, synthetic construct
  source 1..19: mol_type = other RNA
caagatgaggatttgggtt

SEQ ID NO: 57 - RNA, 19 nt, synthetic construct
  source 1..19: mol_type = other RNA
aagatgaggatttgggttt

SEQ ID NO: 58 - RNA, 19 nt, synthetic construct
  source 1..19: mol_type = other RNA
tgaggatttgggttttcta

SEQ ID NO: 59 - DNA, 19 bp, synthetic construct
  source 1..19: mol_type = other DNA
gaagccagaaggacacacg

SEQ ID NO: 60 - RNA, 19 nt, synthetic construct
  source 1..19: mol_type = other RNA
taagccagaaggacacacg

SEQ ID NO: 61 - DNA, 19 bp, synthetic construct
  source 1..19: mol_type = other DNA
naagccagaaggacacacg

SEQ ID NO: 62 - RNA, 19 nt, synthetic construct
  source 1..19: mol_type = other RNA
taagccagaaggacacacn

SEQ ID NO: 63 - DNA, 19 bp, synthetic construct
  source 1..19: mol_type = other DNA
naagccagaaggacacacn

SEQ ID NO: 64 - DNA, 19 bp, synthetic construct
  source 1..19: mol_type = other DNA
gaagccagaaggacacacg

SEQ ID NO: 65 - RNA, 19 nt, synthetic construct
  source 1..19: mol_type = other RNA
taagccagaaggacacacg

SEQ ID NO: 66 - DNA, 19 bp, synthetic construct
  source 1..19: mol_type = other DNA
naagccagaaggacacacg

SEQ ID NO: 67 - RNA, 19 nt, synthetic construct
  source 1..19: mol_type = other RNA
taagccagaaggacacacn

SEQ ID NO: 68 - DNA, 19 bp, synthetic construct
  source 1..19: mol_type = other DNA
naagccagaaggacacacn

SEQ ID NO: 69 - RNA, 19 nt, synthetic construct
  source 1..19: mol_type = other RNA
aaagagatctcatcactca

SEQ ID NO: 70 - RNA, 19 nt, synthetic construct
  source 1..19: mol_type = other RNA
taagagatctcatcactca

SEQ ID NO: 71 - RNA, 19 nt, synthetic construct
  source 1..19: mol_type = other RNA
naagagatctcatcactca

SEQ ID NO: 72 - RNA, 19 nt, synthetic construct
  source 1..19: mol_type = other RNA
aaagagatctcatcactcn

SEQ ID NO: 73 - RNA, 19 nt, synthetic construct
  source 1..19: mol_type = other RNA
taagagatctcatcactcn

SEQ ID NO: 74 - RNA, 19 nt, synthetic construct
  source 1..19: mol_type = other RNA
naagagatctcatcactcn

SEQ ID NO: 75 - RNA, 19 nt, synthetic construct
  source 1..19: mol_type = other RNA
ggaaagagatctcatcact

SEQ ID NO: 76 - RNA, 19 nt, synthetic construct
  source 1..19: mol_type = other RNA
tgaaagagatctcatcact

SEQ ID NO: 77 - RNA, 19 nt, synthetic construct
  source 1..19: mol_type = other RNA
ngaaagagatctcatcact

SEQ ID NO: 78 - RNA, 19 nt, synthetic construct
  source 1..19: mol_type = other RNA
tgaaagagatctcatcacn

SEQ ID NO: 79 - RNA, 19 nt, synthetic construct
  source 1..19: mol_type = other RNA
ngaaagagatctcatcacn

SEQ ID NO: 80 - RNA, 19 nt, synthetic construct
  source 1..19: mol_type = other RNA
agtgtaaccgtcatagcag

SEQ ID NO: 81 - RNA, 19 nt, synthetic construct
  source 1..19: mol_type = other RNA
tgtgtaaccgtcatagcag

SEQ ID NO: 82 - RNA, 19 nt, synthetic construct
  source 1..19: mol_type = other RNA
ngtgtaaccgtcatagcag

SEQ ID NO: 83 - RNA, 19 nt, synthetic construct
  source 1..19: mol_type = other RNA
agtgtaaccgtcatagcan

SEQ ID NO: 84 - RNA, 19 nt, synthetic construct
  source 1..19: mol_type = other RNA
tgtgtaaccgtcatagcan

SEQ ID NO: 85 - RNA, 19 nt, synthetic construct
  source 1..19: mol_type = other RNA
ngtgtaaccgtcatagcan

SEQ ID NO: 86 - RNA, 19 nt, synthetic construct
  source 1..19: mol_type = other RNA
tacatgaaggagtcttggc

SEQ ID NO: 87 - RNA, 19 nt, synthetic construct
  source 1..19: mol_type = other RNA
nacatgaaggagtcttggc

SEQ ID NO: 88 - RNA, 19 nt, synthetic construct
  source 1..19: mol_type = other RNA
tacatgaaggagtcttggn

SEQ ID NO: 89 - RNA, 19 nt, synthetic construct
  source 1..19: mol_type = other RNA
nacatgaaggagtcttggn

SEQ ID NO: 90 - RNA, 19 nt, synthetic construct
  source 1..19: mol_type = other RNA
tcgtacatgaaggagtctt

SEQ ID NO: 91 - RNA, 19 nt, synthetic construct
  source 1..19: mol_type = other RNA
ncgtacatgaaggagtctt

SEQ ID NO: 92 - RNA, 19 nt, synthetic construct
  source 1..19: mol_type = other RNA
tcgtacatgaaggagtctn

SEQ ID NO: 93 - RNA, 19 nt, synthetic construct
  source 1..19: mol_type = other RNA
ncgtacatgaaggagtctn

SEQ ID NO: 94 - RNA, 19 nt, synthetic construct
  source 1..19: mol_type = other RNA
tcgtacatgaaggagtctt

SEQ ID NO: 95 - RNA, 19 nt, synthetic construct
  source 1..19: mol_type = other RNA
ncgtacatgaaggagtctt

SEQ ID NO: 96 - RNA, 19 nt, synthetic construct
  source 1..19: mol_type = other RNA
tcgtacatgaaggagtctn

SEQ ID NO: 97 - RNA, 19 nt, synthetic construct
  source 1..19: mol_type = other RNA
ncgtacatgaaggagtctn

SEQ ID NO: 98 - RNA, 19 nt, synthetic construct
  source 1..19: mol_type = other RNA
gtgtcgtacatgaaggagt

SEQ ID NO: 99 - RNA, 19 nt, synthetic construct
  source 1..19: mol_type = other RNA
ttgtcgtacatgaaggagt

SEQ ID NO: 100 - RNA, 19 nt, synthetic construct
  source 1..19: mol_type = other RNA
ntgtcgtacatgaaggagt

SEQ ID NO: 101 - RNA, 19 nt, synthetic construct
  source 1..19: mol_type = other RNA
ttgtcgtacatgaaggagn

SEQ ID NO: 102 - RNA, 19 nt, synthetic construct
  source 1..19: mol_type = other RNA
ntgtcgtacatgaaggagn

SEQ ID NO: 103 - RNA, 19 nt, synthetic construct
  source 1..19: mol_type = other RNA
gtgtcgtacatgaaggagt

SEQ ID NO: 104 - RNA, 19 nt, synthetic construct
  source 1..19: mol_type = other RNA
ttgtcgtacatgaaggagt

SEQ ID NO: 105 - RNA, 19 nt, synthetic construct
  source 1..19: mol_type = other RNA
ntgtcgtacatgaaggagt

SEQ ID NO: 106 - RNA, 19 nt, synthetic construct
  source 1..19: mol_type = other RNA
ttgtcgtacatgaaggagn

SEQ ID NO: 107 - RNA, 19 nt, synthetic construct
  source 1..19: mol_type = other RNA
ntgtcgtacatgaaggagn

SEQ ID NO: 108 - RNA, 19 nt, synthetic construct
  source 1..19: mol_type = other RNA
atcgactccttctatggtc

SEQ ID NO: 109 - RNA, 19 nt, synthetic construct
  source 1..19: mol_type = other RNA
ttcgactccttctatggtc

SEQ ID NO: 110 - RNA, 19 nt, synthetic construct
  source 1..19: mol_type = other RNA
ntcgactccttctatggtc

SEQ ID NO: 111 - RNA, 19 nt, synthetic construct
  source 1..19: mol_type = other RNA
atcgactccttctatggtn

SEQ ID NO: 112 - RNA, 19 nt, synthetic construct
  source 1..19: mol_type = other RNA
ntcgactccttctatggtn

SEQ ID NO: 113 - RNA, 19 nt, synthetic construct
  source 1..19: mol_type = other RNA
atcgactccttctatggtc

SEQ ID NO: 114 - RNA, 19 nt, synthetic construct
  source 1..19: mol_type = other RNA
ntcgactccttctatggtc

SEQ ID NO: 115 - RNA, 19 nt, synthetic construct
  source 1..19: mol_type = other RNA
atcgactccttctatggtn

SEQ ID NO: 116 - RNA, 19 nt, synthetic construct
  source 1..19: mol_type = other RNA
ntcgactccttctatggtn

SEQ ID NO: 117 - RNA, 19 nt, synthetic construct
  source 1..19: mol_type = other RNA
ccaggtagatgttcatgga

SEQ ID NO: 118 - RNA, 19 nt, synthetic construct
  source 1..19: mol_type = other RNA
tcaggtagatgttcatgga

SEQ ID NO: 119 - RNA, 19 nt, synthetic construct
  source 1..19: mol_type = other RNA
ncaggtagatgttcatgga

SEQ ID NO: 120 - RNA, 19 nt, synthetic construct
  source 1..19: mol_type = other RNA
tcaggtagatgttcatggn

SEQ ID NO: 121 - RNA, 19 nt, synthetic construct
  source 1..19: mol_type = other RNA
ncaggtagatgttcatggn

SEQ ID NO: 122 - RNA, 19 nt, synthetic construct
  source 1..19: mol_type = other RNA
ccaggtagatgttcatgga

SEQ ID NO: 123 - RNA, 19 nt, synthetic construct
  source 1..19: mol_type = other RNA
tcaggtagatgttcatgga

SEQ ID NO: 124 - RNA, 19 nt, synthetic construct
  source 1..19: mol_type = other RNA
ncaggtagatgttcatgga

SEQ ID NO: 125 - RNA, 19 nt, synthetic construct
  source 1..19: mol_type = other RNA
tcaggtagatgttcatggn

SEQ ID NO: 126 - RNA, 19 nt, synthetic construct
  source 1..19: mol_type = other RNA
ncaggtagatgttcatggn

SEQ ID NO: 127 - RNA, 19 nt, synthetic construct
  source 1..19: mol_type = other RNA
tctagcaccaggtagatgt

SEQ ID NO: 128 - RNA, 19 nt, synthetic construct
  source 1..19: mol_type = other RNA
nctagcaccaggtagatgt

SEQ ID NO: 129 - RNA, 19 nt, synthetic construct
  source 1..19: mol_type = other RNA
tctagcaccaggtagatgn

SEQ ID NO: 130 - RNA, 19 nt, synthetic construct
  source 1..19: mol_type = other RNA
nctagcaccaggtagatgn

SEQ ID NO: 131 - RNA, 19 nt, synthetic construct
  source 1..19: mol_type = other RNA
tctagcaccaggtagatgt

SEQ ID NO: 132 - RNA, 19 nt, synthetic construct
  source 1..19: mol_type = other RNA
nctagcaccaggtagatgt

SEQ ID NO: 133 - RNA, 19 nt, synthetic construct
  source 1..19: mol_type = other RNA
tctagcaccaggtagatgn

SEQ ID NO: 134 - RNA, 19 nt, synthetic construct
  source 1..19: mol_type = other RNA
nctagcaccaggtagatgn

SEQ ID NO: 135 - RNA, 19 nt, synthetic construct
  source 1..19: mol_type = other RNA
catctagcaccaggtagat

SEQ ID NO: 136 - RNA, 19 nt, synthetic construct
  source 1..19: mol_type = other RNA
tatctagcaccaggtagat

SEQ ID NO: 137 - RNA, 19 nt, synthetic construct
  source 1..19: mol_type = other RNA
natctagcaccaggtagat

SEQ ID NO: 138 - RNA, 19 nt, synthetic construct
  source 1..19: mol_type = other RNA
tatctagcaccaggtagan

SEQ ID NO: 139 - RNA, 19 nt, synthetic construct
  source 1..19: mol_type = other RNA
natctagcaccaggtagan

SEQ ID NO: 140 - RNA, 19 nt, synthetic construct
  source 1..19: mol_type = other RNA
ccatctagcaccaggtaga

SEQ ID NO: 141 - RNA, 19 nt, synthetic construct
  source 1..19: mol_type = other RNA
tcatctagcaccaggtaga

SEQ ID NO: 142 - RNA, 19 nt, synthetic construct
  source 1..19: mol_type = other RNA
ncatctagcaccaggtaga

SEQ ID NO: 143 - RNA, 19 nt, synthetic construct
  source 1..19: mol_type = other RNA
tcatctagcaccaggtagn

SEQ ID NO: 144 - RNA, 19 nt, synthetic construct
  source 1..19: mol_type = other RNA
ncatctagcaccaggtagn

SEQ ID NO: 145 - RNA, 19 nt, synthetic construct
  source 1..19: mol_type = other RNA
tccatctagcaccaggtag

SEQ ID NO: 146 - RNA, 19 nt, synthetic construct
  source 1..19: mol_type = other RNA
nccatctagcaccaggtag

SEQ ID NO: 147 - RNA, 19 nt, synthetic construct
  source 1..19: mol_type = other RNA
tccatctagcaccaggtan

SEQ ID NO: 148 - RNA, 19 nt, synthetic construct
  source 1..19: mol_type = other RNA
nccatctagcaccaggtan

SEQ ID NO: 149 - RNA, 19 nt, synthetic construct
  source 1..19: mol_type = other RNA
tccatctagcaccaggtag

SEQ ID NO: 150 - RNA, 19 nt, synthetic construct
  source 1..19: mol_type = other RNA
nccatctagcaccaggtag

SEQ ID NO: 151 - RNA, 19 nt, synthetic construct
  source 1..19: mol_type = other RNA
tccatctagcaccaggtan

SEQ ID NO: 152 - RNA, 19 nt, synthetic construct
  source 1..19: mol_type = other RNA
nccatctagcaccaggtan

SEQ ID NO: 153 - RNA, 19 nt, synthetic construct
  source 1..19: mol_type = other RNA
atccatctagcaccaggta

SEQ ID NO: 154 - RNA, 19 nt, synthetic construct
  source 1..19: mol_type = other RNA
ttccatctagcaccaggta

SEQ ID NO: 155 - RNA, 19 nt, synthetic construct
  source 1..19: mol_type = other RNA
ntccatctagcaccaggta

SEQ ID NO: 156 - RNA, 19 nt, synthetic construct
  source 1..19: mol_type = other RNA
atccatctagcaccaggtn

SEQ ID NO: 157 - RNA, 19 nt, synthetic construct
  source 1..19: mol_type = other RNA
ntccatctagcaccaggtn

SEQ ID NO: 158 - RNA, 19 nt, synthetic construct
  source 1..19: mol_type = other RNA
atccatctagcaccaggta

SEQ ID NO: 159 - RNA, 19 nt, synthetic construct
  source 1..19: mol_type = other RNA
ttccatctagcaccaggta

SEQ ID NO: 160 - RNA, 19 nt, synthetic construct
  source 1..19: mol_type = other RNA
ntccatctagcaccaggta

SEQ ID NO: 161 - RNA, 19 nt, synthetic construct
  source 1..19: mol_type = other RNA
atccatctagcaccaggtn

SEQ ID NO: 162 - RNA, 19 nt, synthetic construct
  source 1..19: mol_type = other RNA
ntccatctagcaccaggtn

SEQ ID NO: 163 - RNA, 19 nt, synthetic construct
  source 1..19: mol_type = other RNA
tgatccatctagcaccagg

SEQ ID NO: 164 - RNA, 19 nt, synthetic construct
  source 1..19: mol_type = other RNA
ngatccatctagcaccagg

SEQ ID NO: 165 - RNA, 19 nt, synthetic construct
  source 1..19: mol_type = other RNA
tgatccatctagcaccagn

SEQ ID NO: 166 - RNA, 19 nt, synthetic construct
  source 1..19: mol_type = other RNA
ngatccatctagcaccagn

SEQ ID NO: 167 - RNA, 19 nt, synthetic construct
  source 1..19: mol_type = other RNA
tgatccatctagcaccagg

SEQ ID NO: 168 - RNA, 19 nt, synthetic construct
  source 1..19: mol_type = other RNA
ngatccatctagcaccagg

SEQ ID NO: 169 - RNA, 19 nt, synthetic construct
  source 1..19: mol_type = other RNA
tgatccatctagcaccagn

SEQ ID NO: 170 - RNA, 19 nt, synthetic construct
  source 1..19: mol_type = other RNA
ngatccatctagcaccagn

SEQ ID NO: 171 - RNA, 19 nt, synthetic construct
  source 1..19: mol_type = other RNA
tgtctgatccatctagcac

SEQ ID NO: 172 - RNA, 19 nt, synthetic construct
  source 1..19: mol_type = other RNA
ngtctgatccatctagcac

SEQ ID NO: 173 - RNA, 19 nt, synthetic construct
  source 1..19: mol_type = other RNA
tgtctgatccatctagcan

SEQ ID NO: 174 - RNA, 19 nt, synthetic construct
  source 1..19: mol_type = other RNA
ngtctgatccatctagcan

SEQ ID NO: 175 - RNA, 19 nt, synthetic construct
  source 1..19: mol_type = other RNA
tgtctgatccatctagcac

SEQ ID NO: 176 - RNA, 19 nt, synthetic construct
  source 1..19: mol_type = other RNA
ngtctgatccatctagcac

SEQ ID NO: 177 - RNA, 19 nt, synthetic construct
  source 1..19: mol_type = other RNA
tgtctgatccatctagcan

SEQ ID NO: 178 - RNA, 19 nt, synthetic construct
  source 1..19: mol_type = other RNA
ngtctgatccatctagcan

SEQ ID NO: 179 - RNA, 19 nt, synthetic construct
  source 1..19: mol_type = other RNA
atgctgtctgatccatcta

SEQ ID NO: 180 - RNA, 19 nt, synthetic construct
  source 1..19: mol_type = other RNA
ttgctgtctgatccatcta

SEQ ID NO: 181 - RNA, 19 nt, synthetic construct
  source 1..19: mol_type = other RNA
ntgctgtctgatccatcta

SEQ ID NO: 182 - RNA, 19 nt, synthetic construct
  source 1..19: mol_type = other RNA
atgctgtctgatccatctn

SEQ ID NO: 183 - RNA, 19 nt, synthetic construct
  source 1..19: mol_type = other RNA
ntgctgtctgatccatctn

SEQ ID NO: 184 - RNA, 19 nt, synthetic construct
  source 1..19: mol_type = other RNA
atgctgtctgatccatcta

SEQ ID NO: 185 - RNA, 19 nt, synthetic construct
  source 1..19: mol_type = other RNA
ttgctgtctgatccatcta

SEQ ID NO: 186 - RNA, 19 nt, synthetic construct
  source 1..19: mol_type = other RNA
ntgctgtctgatccatcta

SEQ ID NO: 187 - RNA, 19 nt, synthetic construct
  source 1..19: mol_type = other RNA
atgctgtctgatccatctn

SEQ ID NO: 188 - RNA, 19 nt, synthetic construct
  source 1..19: mol_type = other RNA
ntgctgtctgatccatctn

SEQ ID NO: 189 - RNA, 19 nt, synthetic construct
  source 1..19: mol_type = other RNA
ccccaatgctgtctgatcc

SEQ ID NO: 190 - RNA, 19 nt, synthetic construct
  source 1..19: mol_type = other RNA
tcccaatgctgtctgatcc

SEQ ID NO: 191 - RNA, 19 nt, synthetic construct
  source 1..19: mol_type = other RNA
ncccaatgctgtctgatcc

SEQ ID NO: 192 - RNA, 19 nt, synthetic construct
  source 1..19: mol_type = other RNA
tcccaatgctgtctgatcn

SEQ ID NO: 193 - RNA, 19 nt, synthetic construct
  source 1..19: mol_type = other RNA
ncccaatgctgtctgatcn

SEQ ID NO: 194 - RNA, 19 nt, synthetic construct
  source 1..19: mol_type = other RNA
ccccaatgctgtctgatcc

SEQ ID NO: 195 - RNA, 19 nt, synthetic construct
  source 1..19: mol_type = other RNA
tcccaatgctgtctgatcc

SEQ ID NO: 196 - RNA, 19 nt, synthetic construct
  source 1..19: mol_type = other RNA
ncccaatgctgtctgatcc

SEQ ID NO: 197 - RNA, 19 nt, synthetic construct
  source 1..19: mol_type = other RNA
tcccaatgctgtctgatcn

SEQ ID NO: 198 - RNA, 19 nt, synthetic construct
  source 1..19: mol_type = other RNA
ncccaatgctgtctgatcn

SEQ ID NO: 199 - RNA, 19 nt, synthetic construct
  source 1..19: mol_type = other RNA
tgactagacactttttggc

SEQ ID NO: 200 - RNA, 19 nt, synthetic construct
  source 1..19: mol_type = other RNA
ngactagacactttttggc

SEQ ID NO: 201 - RNA, 19 nt, synthetic construct
  source 1..19: mol_type = other RNA
tgactagacactttttggn

SEQ ID NO: 202 - RNA, 19 nt, synthetic construct
  source 1..19: mol_type = other RNA
ngactagacactttttggn

SEQ ID NO: 203 - RNA, 19 nt, synthetic construct
  source 1..19: mol_type = other RNA
tgactagacactttttggc

SEQ ID NO: 204 - RNA, 19 nt, synthetic construct
  source 1..19: mol_type = other RNA
ngactagacactttttggc

SEQ ID NO: 205 - RNA, 19 nt, synthetic construct
  source 1..19: mol_type = other RNA
tgactagacactttttggn

SEQ ID NO: 206 - RNA, 19 nt, synthetic construct
  source 1..19: mol_type = other RNA
ngactagacactttttggn

SEQ ID NO: 207 - RNA, 19 nt, synthetic construct
  source 1..19: mol_type = other RNA
gttgactagacactttttg

SEQ ID NO: 208 - RNA, 19 nt, synthetic construct
  source 1..19: mol_type = other RNA
tttgactagacactttttg

SEQ ID NO: 209 - RNA, 19 nt, synthetic construct
  source 1..19: mol_type = other RNA
nttgactagacactttttg

SEQ ID NO: 210 - RNA, 19 nt, synthetic construct
  source 1..19: mol_type = other RNA
tttgactagacactttttn

SEQ ID NO: 211 - RNA, 19 nt, synthetic construct
  source 1..19: mol_type = other RNA
nttgactagacactttttn

SEQ ID NO: 212 - RNA, 19 nt, synthetic construct
  source 1..19: mol_type = other RNA
aagttgactagacactttt

SEQ ID NO: 213 - RNA, 19 nt, synthetic construct
  source 1..19: mol_type = other RNA
tagttgactagacactttt

SEQ ID NO: 214 - RNA, 19 nt, synthetic construct
  source 1..19: mol_type = other RNA
nagttgactagacactttt

SEQ ID NO: 215 - RNA, 19 nt, synthetic construct
  source 1..19: mol_type = other RNA
aagttgactagacactttn

SEQ ID NO: 216 - RNA, 19 nt, synthetic construct
  source 1..19: mol_type = other RNA
nagttgactagacactttn

SEQ ID NO: 217 - RNA, 19 nt, synthetic construct
  source 1..19: mol_type = other RNA
accataacttgccaccttc

SEQ ID NO: 218 - RNA, 19 nt, synthetic construct
  source 1..19: mol_type = other RNA
tccataacttgccaccttc

SEQ ID NO: 219 - RNA, 19 nt, synthetic construct
  source 1..19: mol_type = other RNA
nccataacttgccaccttc

SEQ ID NO: 220 - RNA, 19 nt, synthetic construct
  source 1..19: mol_type = other RNA
accataacttgccaccttn

SEQ ID NO: 221 - RNA, 19 nt, synthetic construct
  source 1..19: mol_type = other RNA
nccataacttgccaccttn

SEQ ID NO: 222 - RNA, 19 nt, synthetic construct
  source 1..19: mol_type = other RNA
caccataacttgccacctt

SEQ ID NO: 223 - RNA, 19 nt, synthetic construct
  source 1..19: mol_type = other RNA
taccataacttgccacctt

SEQ ID NO: 224 - RNA, 19 nt, synthetic construct
  source 1..19: mol_type = other RNA
naccataacttgccacctt

SEQ ID NO: 225 - RNA, 19 nt, synthetic construct
  source 1..19: mol_type = other RNA
taccataacttgccacctn

SEQ ID NO: 226 - RNA, 19 nt, synthetic construct
  source 1..19: mol_type = other RNA
naccataacttgccacctn

SEQ ID NO: 227 - RNA, 19 nt, synthetic construct
  source 1..19: mol_type = other RNA
cttggcttcacaccataac

SEQ ID NO: 228 - RNA, 19 nt, synthetic construct
  source 1..19: mol_type = other RNA
tttggcttcacaccataac

SEQ ID NO: 229 - RNA, 19 nt, synthetic construct
  source 1..19: mol_type = other RNA
nttggcttcacaccataac

SEQ ID NO: 230 - RNA, 19 nt, synthetic construct
  source 1..19: mol_type = other RNA
tttggcttcacaccataan

SEQ ID NO: 231 - RNA, 19 nt, synthetic construct
  source 1..19: mol_type = other RNA
nttggcttcacaccataan

SEQ ID NO: 232 - RNA, 19 nt, synthetic construct
  source 1..19: mol_type = other RNA
cttggcttcacaccataac

SEQ ID NO: 233 - RNA, 19 nt, synthetic construct
  source 1..19: mol_type = other RNA
tttggcttcacaccataac

SEQ ID NO: 234 - RNA, 19 nt, synthetic construct
  source 1..19: mol_type = other RNA
nttggcttcacaccataac

SEQ ID NO: 235 - RNA, 19 nt, synthetic construct
  source 1..19: mol_type = other RNA
tttggcttcacaccataan

SEQ ID NO: 236 - RNA, 19 nt, synthetic construct
  source 1..19: mol_type = other RNA
nttggcttcacaccataan

SEQ ID NO: 237 - RNA, 19 nt, synthetic construct
  source 1..19: mol_type = other RNA
tcatcatgctgtacactgc

SEQ ID NO: 238 - RNA, 19 nt, synthetic construct
  source 1..19: mol_type = other RNA
ncatcatgctgtacactgc

SEQ ID NO: 239 - RNA, 19 nt, synthetic construct
  source 1..19: mol_type = other RNA
tcatcatgctgtacactgn

SEQ ID NO: 240 - RNA, 19 nt, synthetic construct
  source 1..19: mol_type = other RNA
ncatcatgctgtacactgn

SEQ ID NO: 241 - RNA, 19 nt, synthetic construct
  source 1..19: mol_type = other RNA
ccatgttgtgcaatccatc

SEQ ID NO: 242 - RNA, 19 nt, synthetic construct
  source 1..19: mol_type = other RNA
tcatgttgtgcaatccatc

SEQ ID NO: 243 - RNA, 19 nt, synthetic construct
  source 1..19: mol_type = other RNA
ncatgttgtgcaatccatc

SEQ ID NO: 244 - RNA, 19 nt, synthetic construct
  source 1..19: mol_type = other RNA
tcatgttgtgcaatccatn

SEQ ID NO: 245 - RNA, 19 nt, synthetic construct
  source 1..19: mol_type = other RNA
ncatgttgtgcaatccatn

SEQ ID NO: 246 - RNA, 19 nt, synthetic construct
  source 1..19: mol_type = other RNA
tcaatgacagtaattgggt

SEQ ID NO: 247 - RNA, 19 nt, synthetic construct
  source 1..19: mol_type = other RNA
ncaatgacagtaattgggt

SEQ ID NO: 248 - RNA, 19 nt, synthetic construct
  source 1..19: mol_type = other RNA
tcaatgacagtaattgggn

SEQ ID NO: 249 - RNA, 19 nt, synthetic construct
  source 1..19: mol_type = other RNA
ncaatgacagtaattgggn

SEQ ID NO: 250 - RNA, 19 nt, synthetic construct
  source 1..19: mol_type = other RNA
atcaatgacagtaattggg

SEQ ID NO: 251 - RNA, 19 nt, synthetic construct
  source 1..19: mol_type = other RNA
ttcaatgacagtaattggg

SEQ ID NO: 252 - RNA, 19 nt, synthetic construct
  source 1..19: mol_type = other RNA
ntcaatgacagtaattggg

SEQ ID NO: 253 - RNA, 19 nt, synthetic construct
  source 1..19: mol_type = other RNA
atcaatgacagtaattggn

SEQ ID NO: 254 - RNA, 19 nt, synthetic construct
  source 1..19: mol_type = other RNA
ntcaatgacagtaattggn

SEQ ID NO: 255 - RNA, 19 nt, synthetic construct
  source 1..19: mol_type = other RNA
tcatcaatgacagtaattg

SEQ ID NO: 256 - RNA, 19 nt, synthetic construct
  source 1..19: mol_type = other RNA
ncatcaatgacagtaattg

SEQ ID NO: 257 - RNA, 19 nt, synthetic construct
  source 1..19: mol_type = other RNA
tcatcaatgacagtaattn

SEQ ID NO: 258 - RNA, 19 nt, synthetic construct
  source 1..19: mol_type = other RNA
ncatcaatgacagtaattn

SEQ ID NO: 259 - RNA, 19 nt, synthetic construct
  source 1..19: mol_type = other RNA
cggatctcatcaatgacag

SEQ ID NO: 260 - RNA, 19 nt, synthetic construct
  source 1..19: mol_type = other RNA
tggatctcatcaatgacag

SEQ ID NO: 261 - RNA, 19 nt, synthetic construct
  source 1..19: mol_type = other RNA
nggatctcatcaatgacag

SEQ ID NO: 262 - RNA, 19 nt, synthetic construct
  source 1..19: mol_type = other RNA
tggatctcatcaatgacan

SEQ ID NO: 263 - RNA, 19 nt, synthetic construct
  source 1..19: mol_type = other RNA
nggatctcatcaatgacan

SEQ ID NO: 264 - RNA, 19 nt, synthetic construct
  source 1..19: mol_type = other RNA
cggatctcatcaatgacag

SEQ ID NO: 265 - RNA, 19 nt, synthetic construct
  source 1..19: mol_type = other RNA
tggatctcatcaatgacag

SEQ ID NO: 266 - RNA, 19 nt, synthetic construct
  source 1..19: mol_type = other RNA
nggatctcatcaatgacag

SEQ ID NO: 267 - RNA, 19 nt, synthetic construct
  source 1..19: mol_type = other RNA
tggatctcatcaatgacan

SEQ ID NO: 268 - RNA, 19 nt, synthetic construct
  source 1..19: mol_type = other RNA
nggatctcatcaatgacan

SEQ ID NO: 269 - RNA, 19 nt, synthetic construct
  source 1..19: mol_type = other RNA
tagacatccagataatcct

SEQ ID NO: 270 - RNA, 19 nt, synthetic construct
  source 1..19: mol_type = other RNA
nagacatccagataatcct

SEQ ID NO: 271 - RNA, 19 nt, synthetic construct
  source 1..19: mol_type = other RNA
tagacatccagataatccn

SEQ ID NO: 272 - RNA, 19 nt, synthetic construct
  source 1..19: mol_type = other RNA
nagacatccagataatccn

SEQ ID NO: 273 - RNA, 19 nt, synthetic construct
  source 1..19: mol_type = other RNA
aaacacatagacatccaga

SEQ ID NO: 274 - RNA, 19 nt, synthetic construct
  source 1..19: mol_type = other RNA
taacacatagacatccaga

SEQ ID NO: 275 - RNA, 19 nt, synthetic construct
  source 1..19: mol_type = other RNA
naacacatagacatccaga

SEQ ID NO: 276 - RNA, 19 nt, synthetic construct
  source 1..19: mol_type = other RNA
aaacacatagacatccagn

SEQ ID NO: 277 - RNA, 19 nt, synthetic construct
  source 1..19: mol_type = other RNA
naacacatagacatccagn

SEQ ID NO: 278 - RNA, 19 nt, synthetic construct
  source 1..19: mol_type = other RNA
ccaaacacatagacatcca

SEQ ID NO: 279 - RNA, 19 nt, synthetic construct
  source 1..19: mol_type = other RNA
tcaaacacatagacatcca

SEQ ID NO: 280 - RNA, 19 nt, synthetic construct
  source 1..19: mol_type = other RNA
ncaaacacatagacatcca

SEQ ID NO: 281 - RNA, 19 nt, synthetic construct
  source 1..19: mol_type = other RNA
tcaaacacatagacatccn

SEQ ID NO: 282 - RNA, 19 nt, synthetic construct
  source 1..19: mol_type = other RNA
ncaaacacatagacatccn

SEQ ID NO: 283 - RNA, 19 nt, synthetic construct
  source 1..19: mol_type = other RNA
gcattgatgttcacttggt

SEQ ID NO: 284 - RNA, 19 nt, synthetic construct
  source 1..19: mol_type = other RNA
tcattgatgttcacttggt

SEQ ID NO: 285 - RNA, 19 nt, synthetic construct
  source 1..19: mol_type = other RNA
ncattgatgttcacttggt

SEQ ID NO: 286 - RNA, 19 nt, synthetic construct
  source 1..19: mol_type = other RNA
tcattgatgttcacttggn

SEQ ID NO: 287 - RNA, 19 nt, synthetic construct
  source 1..19: mol_type = other RNA
ncattgatgttcacttggn

SEQ ID NO: 288 - RNA, 19 nt, synthetic construct
  source 1..19: mol_type = other RNA
aaagcattgatgttcactt

SEQ ID NO: 289 - RNA, 19 nt, synthetic construct
  source 1..19: mol_type = other RNA
taagcattgatgttcactt

SEQ ID NO: 290 - RNA, 19 nt, synthetic construct
  source 1..19: mol_type = other RNA
naagcattgatgttcactt

SEQ ID NO: 291 - RNA, 19 nt, synthetic construct
  source 1..19: mol_type = other RNA
aaagcattgatgttcactn

SEQ ID NO: 292 - RNA, 19 nt, synthetic construct
  source 1..19: mol_type = other RNA
naagcattgatgttcactn

SEQ ID NO: 293 - RNA, 19 nt, synthetic construct
  source 1..19: mol_type = other RNA
agccaaagcattgatgttc

SEQ ID NO: 294 - RNA, 19 nt, synthetic construct
  source 1..19: mol_type = other RNA
tgccaaagcattgatgttc

SEQ ID NO: 295 - RNA, 19 nt, synthetic construct
  source 1..19: mol_type = other RNA
ngccaaagcattgatgttc

SEQ ID NO: 296 - RNA, 19 nt, synthetic construct
  source 1..19: mol_type = other RNA
agccaaagcattgatgttn

SEQ ID NO: 297 - RNA, 19 nt, synthetic construct
  source 1..19: mol_type = other RNA
ngccaaagcattgatgttn

SEQ ID NO: 298 - RNA, 19 nt, synthetic construct
  source 1..19: mol_type = other RNA
agccaaagcattgatgttc

SEQ ID NO: 299 - RNA, 19 nt, synthetic construct
  source 1..19: mol_type = other RNA
tgccaaagcattgatgttc

SEQ ID NO: 300 - RNA, 19 nt, synthetic construct
  source 1..19: mol_type = other RNA
ngccaaagcattgatgttc

SEQ ID NO: 301 - RNA, 19 nt, synthetic construct
  source 1..19: mol_type = other RNA
agccaaagcattgatgttn

SEQ ID NO: 302 - RNA, 19 nt, synthetic construct
  source 1..19: mol_type = other RNA
ngccaaagcattgatgttn

SEQ ID NO: 303 - RNA, 19 nt, synthetic construct
  source 1..19: mol_type = other RNA
gaagccaaagcattgatgt

SEQ ID NO: 304 - RNA, 19 nt, synthetic construct
  source 1..19: mol_type = other RNA
taagccaaagcattgatgt

SEQ ID NO: 305 - RNA, 19 nt, synthetic construct
  source 1..19: mol_type = other RNA
naagccaaagcattgatgt

SEQ ID NO: 306 - RNA, 19 nt, synthetic construct
  source 1..19: mol_type = other RNA
taagccaaagcattgatgn

SEQ ID NO: 307 - RNA, 19 nt, synthetic construct
  source 1..19: mol_type = other RNA
naagccaaagcattgatgn

SEQ ID NO: 308 - RNA, 19 nt, synthetic construct
  source 1..19: mol_type = other RNA
gaagccaaagcattgatgt

SEQ ID NO: 309 - RNA, 19 nt, synthetic construct
  source 1..19: mol_type = other RNA
taagccaaagcattgatgt

SEQ ID NO: 310 - RNA, 19 nt, synthetic construct
  source 1..19: mol_type = other RNA
naagccaaagcattgatgt

SEQ ID NO: 311 - RNA, 19 nt, synthetic construct
  source 1..19: mol_type = other RNA
taagccaaagcattgatgn

SEQ ID NO: 312 - RNA, 19 nt, synthetic construct
  source 1..19: mol_type = other RNA
naagccaaagcattgatgn

SEQ ID NO: 313 - RNA, 19 nt, synthetic construct
  source 1..19: mol_type = other RNA
tgttgctcattgtctttct

SEQ ID NO: 314 - RNA, 19 nt, synthetic construct
  source 1..19: mol_type = other RNA
ngttgctcattgtctttct

SEQ ID NO: 315 - RNA, 19 nt, synthetic construct
  source 1..19: mol_type = other RNA
tgttgctcattgtctttcn

SEQ ID NO: 316 - RNA, 19 nt, synthetic construct
  source 1..19: mol_type = other RNA
ngttgctcattgtctttcn

SEQ ID NO: 317 - RNA, 19 nt, synthetic construct
  source 1..19: mol_type = other RNA
tgttgctcattgtctttct

SEQ ID NO: 318 - RNA, 19 nt, synthetic construct
  source 1..19: mol_type = other RNA
ngttgctcattgtctttct

SEQ ID NO: 319 - RNA, 19 nt, synthetic construct
  source 1..19: mol_type = other RNA
tgttgctcattgtctttcn

SEQ ID NO: 320 - RNA, 19 nt, synthetic construct
  source 1..19: mol_type = other RNA
ngttgctcattgtctttcn

SEQ ID NO: 321 - RNA, 19 nt, synthetic construct
  source 1..19: mol_type = other RNA
acatgttgctcattgtctt

SEQ ID NO: 322 - RNA, 19 nt, synthetic construct
  source 1..19: mol_type = other RNA
tcatgttgctcattgtctt

SEQ ID NO: 323 - RNA, 19 nt, synthetic construct
  source 1..19: mol_type = other RNA
ncatgttgctcattgtctt

SEQ ID NO: 324 - RNA, 19 nt, synthetic construct
  source 1..19: mol_type = other RNA
acatgttgctcattgtctn

SEQ ID NO: 325 - RNA, 19 nt, synthetic construct
  source 1..19: mol_type = other RNA
ncatgttgctcattgtctn

SEQ ID NO: 326 - RNA, 19 nt, synthetic construct
  source 1..19: mol_type = other RNA
catgccacagagactcaga

SEQ ID NO: 327 - RNA, 19 nt, synthetic construct
  source 1..19: mol_type = other RNA
tatgccacagagactcaga

SEQ ID NO: 328 - RNA, 19 nt, synthetic construct
  source 1..19: mol_type = other RNA
natgccacagagactcaga

SEQ ID NO: 329 - RNA, 19 nt, synthetic construct
  source 1..19: mol_type = other RNA
tatgccacagagactcagn

SEQ ID NO: 330 - RNA, 19 nt, synthetic construct
  source 1..19: mol_type = other RNA
natgccacagagactcagn

SEQ ID NO: 331 - RNA, 19 nt, synthetic construct
  source 1..19: mol_type = other RNA
catgccacagagactcaga

SEQ ID NO: 332 - RNA, 19 nt, synthetic construct
  source 1..19: mol_type = other RNA
tatgccacagagactcaga

SEQ ID NO: 333 - RNA, 19 nt, synthetic construct
  source 1..19: mol_type = other RNA
natgccacagagactcaga

SEQ ID NO: 334 - RNA, 19 nt, synthetic construct
  source 1..19: mol_type = other RNA
tatgccacagagactcagn

SEQ ID NO: 335 - RNA, 19 nt, synthetic construct
  source 1..19: mol_type = other RNA
natgccacagagactcagn

SEQ ID NO: 336 - RNA, 19 nt, synthetic construct
  source 1..19: mol_type = other RNA
ttgcttgtggtaatcggta

SEQ ID NO: 337 - RNA, 19 nt, synthetic construct
  source 1..19: mol_type = other RNA
ntgcttgtggtaatcggta

SEQ ID NO: 338 - RNA, 19 nt, synthetic construct
  source 1..19: mol_type = other RNA
ttgcttgtggtaatcggtn

SEQ ID NO: 339 - RNA, 19 nt, synthetic construct
  source 1..19: mol_type = other RNA
ntgcttgtggtaatcggtn

SEQ ID NO: 340 - RNA, 19 nt, synthetic construct
  source 1..19: mol_type = other RNA
ttgcttgtggtaatcggta

SEQ ID NO: 341 - RNA, 19 nt, synthetic construct
  source 1..19: mol_type = other RNA
ntgcttgtggtaatcggta

SEQ ID NO: 342 - RNA, 19 nt, synthetic construct
  source 1..19: mol_type = other RNA
ttgcttgtggtaatcggtn

SEQ ID NO: 343 - RNA, 19 nt, synthetic construct
  source 1..19: mol_type = other RNA
ntgcttgtggtaatcggtn

SEQ ID NO: 344 - RNA, 19 nt, synthetic construct
  source 1..19: mol_type = other RNA
ggttgcttgtggtaatcgg

SEQ ID NO: 345 - RNA, 19 nt, synthetic construct
  source 1..19: mol_type = other RNA
tgttgcttgtggtaatcgg

SEQ ID NO: 346 - RNA, 19 nt, synthetic construct
  source 1..19: mol_type = other RNA
ngttgcttgtggtaatcgg

SEQ ID NO: 347 - RNA, 19 nt, synthetic construct
  source 1..19: mol_type = other RNA
tgttgcttgtggtaatcgn

SEQ ID NO: 348 - RNA, 19 nt, synthetic construct
  source 1..19: mol_type = other RNA
ngttgcttgtggtaatcgn

SEQ ID NO: 349 - RNA, 19 nt, synthetic construct
  source 1..19: mol_type = other RNA
ggttgcttgtggtaatcgg

SEQ ID NO: 350 - RNA, 19 nt, synthetic construct
  source 1..19: mol_type = other RNA
tgttgcttgtggtaatcgg

SEQ ID NO: 351 - RNA, 19 nt, synthetic construct
  source 1..19: mol_type = other RNA
ngttgcttgtggtaatcgg

SEQ ID NO: 352 - RNA, 19 nt, synthetic construct
  source 1..19: mol_type = other RNA
tgttgcttgtggtaatcgn

SEQ ID NO: 353 - RNA, 19 nt, synthetic construct
  source 1..19: mol_type = other RNA
ngttgcttgtggtaatcgn

SEQ ID NO: 354 - RNA, 19 nt, synthetic construct
  source 1..19: mol_type = other RNA
ctgagatcttggcctgcca

SEQ ID NO: 355 - RNA, 19 nt, synthetic construct
  source 1..19: mol_type = other RNA
ttgagatcttggcctgcca

SEQ ID NO: 356 - RNA, 19 nt, synthetic construct
  source 1..19: mol_type = other RNA
ntgagatcttggcctgcca

SEQ ID NO: 357 - RNA, 19 nt, synthetic construct
  source 1..19: mol_type = other RNA
ttgagatcttggcctgccn

SEQ ID NO: 358 - RNA, 19 nt, synthetic construct
  source 1..19: mol_type = other RNA
ntgagatcttggcctgccn

SEQ ID NO: 359 - RNA, 19 nt, synthetic construct
  source 1..19: mol_type = other RNA
aaagtactcagacaccaca

SEQ ID NO: 360 - RNA, 19 nt, synthetic construct
  source 1..19: mol_type = other RNA
taagtactcagacaccaca

SEQ ID NO: 361 - RNA, 19 nt, synthetic construct
  source 1..19: mol_type = other RNA
taagtactcagacaccata

SEQ ID NO: 362 - RNA, 19 nt, synthetic construct
  source 1..19: mol_type = other RNA
naagtactcagacaccaca

SEQ ID NO: 363 - RNA, 19 nt, synthetic construct
  source 1..19: mol_type = other RNA
aaagtactcagacaccacn

SEQ ID NO: 364 - RNA, 19 nt, synthetic construct
  source 1..19: mol_type = other RNA
taagtactcagacaccacn

SEQ ID NO: 365 - RNA, 19 nt, synthetic construct
  source 1..19: mol_type = other RNA
naagtactcagacaccacn

SEQ ID NO: 366 - RNA, 19 nt, synthetic construct
  source 1..19: mol_type = other RNA
aaagtactcagacaccaca

SEQ ID NO: 367 - RNA, 19 nt, synthetic construct
  source 1..19: mol_type = other RNA
taagtactcagacactaca

SEQ ID NO: 368 - RNA, 19 nt, synthetic construct
  source 1..19: mol_type = other RNA
naagtactcagacactaca

SEQ ID NO: 369 - RNA, 19 nt, synthetic construct
  source 1..19: mol_type = other RNA
aaagtactcagacactacn

SEQ ID NO: 370 - RNA, 19 nt, synthetic construct
  source 1..19: mol_type = other RNA
taagtactcagacactacn

SEQ ID NO: 371 - RNA, 19 nt, synthetic construct
  source 1..19: mol_type = other RNA
naagtactcagacactacn

SEQ ID NO: 372 - RNA, 19 nt, synthetic construct
  source 1..19: mol_type = other RNA
naagtactcagacaccata

SEQ ID NO: 373 - RNA, 19 nt, synthetic construct
  source 1..19: mol_type = other RNA
taagtactcagacaccatn

SEQ ID NO: 374 - RNA, 19 nt, synthetic construct
  source 1..19: mol_type = other RNA
naagtactcagacaccatn

SEQ ID NO: 375 - RNA, 19 nt, synthetic construct
  source 1..19: mol_type = other RNA
agcacaaagtactcagaca

SEQ ID NO: 376 - RNA, 19 nt, synthetic construct
  source 1..19: mol_type = other RNA
tgcacaaagtactcagaca

SEQ ID NO: 377 - RNA, 19 nt, synthetic construct
  source 1..19: mol_type = other RNA
ngcacaaagtactcagaca

SEQ ID NO: 378 - RNA, 19 nt, synthetic construct
  source 1..19: mol_type = other RNA
agcacaaagtactcagacn

SEQ ID NO: 379 - RNA, 19 nt, synthetic construct
  source 1..19: mol_type = other RNA
ngcacaaagtactcagacn

SEQ ID NO: 380 - RNA, 19 nt, synthetic construct
  source 1..19: mol_type = other RNA
agcacaaagtactcagaca

SEQ ID NO: 381 - RNA, 19 nt, synthetic construct
  source 1..19: mol_type = other RNA
tgcacaaagtactcagaca

SEQ ID NO: 382 - RNA, 19 nt, synthetic construct
  source 1..19: mol_type = other RNA
ngcacaaagtactcagaca

SEQ ID NO: 383 - RNA, 19 nt, synthetic construct
  source 1..19: mol_type = other RNA
agcacaaagtactcagacn

SEQ ID NO: 384 - RNA, 19 nt, synthetic construct
  source 1..19: mol_type = other RNA
ngcacaaagtactcagacn

SEQ ID NO: 385 - RNA, 19 nt, synthetic construct
  source 1..19: mol_type = other RNA
cagcacaaagtactcagac

SEQ ID NO: 386 - RNA, 19 nt, synthetic construct
  source 1..19: mol_type = other RNA
tagcacaaagtactcagac

SEQ ID NO: 387 - RNA, 19 nt, synthetic construct
  source 1..19: mol_type = other RNA
nagcacaaagtactcagac

SEQ ID NO: 388 - RNA, 19 nt, synthetic construct
  source 1..19: mol_type = other RNA
tagcacaaagtactcagan

SEQ ID NO: 389 - RNA, 19 nt, synthetic construct
  source 1..19: mol_type = other RNA
nagcacaaagtactcagan

SEQ ID NO: 390 - RNA, 19 nt, synthetic construct
  source 1..19: mol_type = other RNA
cagcacaaagtactcagac

SEQ ID NO: 391 - RNA, 19 nt, synthetic construct
  source 1..19: mol_type = other RNA
tagcacaaagtactcagac

SEQ ID NO: 392 - RNA, 19 nt, synthetic construct
  source 1..19: mol_type = other RNA
nagcacaaagtactcagac

SEQ ID NO: 393 - RNA, 19 nt, synthetic construct
  source 1..19: mol_type = other RNA
tagcacaaagtactcagan

SEQ ID NO: 394 - RNA, 19 nt, synthetic construct
  source 1..19: mol_type = other RNA
nagcacaaagtactcagan

SEQ ID NO: 395 - RNA, 19 nt, synthetic construct
  source 1..19: mol_type = other RNA
aaacaatgtgctgctgtca

SEQ ID NO: 396 - RNA, 19 nt, synthetic construct
  source 1..19: mol_type = other RNA
taacaatgtgctgctgtca

SEQ ID NO: 397 - RNA, 19 nt, synthetic construct
  source 1..19: mol_type = other RNA
naacaatgtgctgctgtca

SEQ ID NO: 398 - RNA, 19 nt, synthetic construct
  source 1..19: mol_type = other RNA
aaacaatgtgctgctgtcn

SEQ ID NO: 399 - RNA, 19 nt, synthetic construct
  source 1..19: mol_type = other RNA
naacaatgtgctgctgtcn

SEQ ID NO: 400 - RNA, 19 nt, synthetic construct
  source 1..19: mol_type = other RNA
gcttgatcagggcaacgtc

SEQ ID NO: 401 - RNA, 19 nt, synthetic construct
  source 1..19: mol_type = other RNA
tcttgatcagggcaacgtc

SEQ ID NO: 402 - RNA, 19 nt, synthetic construct
  source 1..19: mol_type = other RNA
ncttgatcagggcaacgtc

SEQ ID NO: 403 - RNA, 19 nt, synthetic construct
  source 1..19: mol_type = other RNA
tcttgatcagggcaacgtn

SEQ ID NO: 404 - RNA, 19 nt, synthetic construct
  source 1..19: mol_type = other RNA
ncttgatcagggcaacgtn

SEQ ID NO: 405 - RNA, 19 nt, synthetic construct
  source 1..19: mol_type = other RNA
agcttgatcagggcaacgt

SEQ ID NO: 406 - RNA, 19 nt, synthetic construct
  source 1..19: mol_type = other RNA
tgcttgatcagggcaacgt

SEQ ID NO: 407 - RNA, 19 nt, synthetic construct
  source 1..19: mol_type = other RNA
ngcttgatcagggcaacgt

SEQ ID NO: 408 - RNA, 19 nt, synthetic construct
  source 1..19: mol_type = other RNA
agcttgatcagggcaacgn

SEQ ID NO: 409 - RNA, 19 nt, synthetic construct
  source 1..19: mol_type = other RNA
ngcttgatcagggcaacgn

SEQ ID NO: 410 - RNA, 19 nt, synthetic construct
  source 1..19: mol_type = other RNA
agcttgatcagggcaacgt

SEQ ID NO: 411 - RNA, 19 nt, synthetic construct
  source 1..19: mol_type = other RNA
tgcttgatcagggcaacgt

SEQ ID NO: 412 - RNA, 19 nt, synthetic construct
  source 1..19: mol_type = other RNA
ngcttgatcagggcaacgt

SEQ ID NO: 413 - RNA, 19 nt, synthetic construct
  source 1..19: mol_type = other RNA
agcttgatcagggcaacgn

SEQ ID NO: 414 - RNA, 19 nt, synthetic construct
  source 1..19: mol_type = other RNA
ngcttgatcagggcaacgn

SEQ ID NO: 415 - RNA, 19 nt, synthetic construct
  source 1..19: mol_type = other RNA
tacaccaacttgaatgaaa

SEQ ID NO: 416 - RNA, 19 nt, synthetic construct
  source 1..19: mol_type = other RNA
nacaccaacttgaatgaaa

SEQ ID NO: 417 - RNA, 19 nt, synthetic construct
  source 1..19: mol_type = other RNA
tacaccaacttgaatgaan

SEQ ID NO: 418 - RNA, 19 nt, synthetic construct
  source 1..19: mol_type = other RNA
nacaccaacttgaatgaan

SEQ ID NO: 419 - RNA, 19 nt, synthetic construct
  source 1..19: mol_type = other RNA
tacaccaacttgaatgaaa

SEQ ID NO: 420 - RNA, 19 nt, synthetic construct
  source 1..19: mol_type = other RNA
nacaccaacttgaatgaaa

SEQ ID NO: 421 - RNA, 19 nt, synthetic construct
  source 1..19: mol_type = other RNA
tacaccaacttgaatgaan

SEQ ID NO: 422 - RNA, 19 nt, synthetic construct
  source 1..19: mol_type = other RNA
nacaccaacttgaatgaan

SEQ ID NO: 423 - RNA, 19 nt, synthetic construct
  source 1..19: mol_type = other RNA
cactactccccagctgatt

SEQ ID NO: 424 - RNA, 19 nt, synthetic construct
  source 1..19: mol_type = other RNA
tactactccccagctgatt

SEQ ID NO: 425 - RNA, 19 nt, synthetic construct
  source 1..19: mol_type = other RNA
nactactccccagctgatt

SEQ ID NO: 426 - RNA, 19 nt, synthetic construct
  source 1..19: mol_type = other RNA
tactactccccagctgatn

SEQ ID NO: 427 - RNA, 19 nt, synthetic construct
  source 1..19: mol_type = other RNA
nactactccccagctgatn

SEQ ID NO: 428 - RNA, 19 nt, synthetic construct
  source 1..19: mol_type = other RNA
cactactccccagctgatt

SEQ ID NO: 429 - RNA, 19 nt, synthetic construct
  source 1..19: mol_type = other RNA
tactactccccagctgatt

SEQ ID NO: 430 - RNA, 19 nt, synthetic construct
  source 1..19: mol_type = other RNA
nactactccccagctgatt

SEQ ID NO: 431 - RNA, 19 nt, synthetic construct
  source 1..19: mol_type = other RNA
tccactactccccagctga

SEQ ID NO: 432 - RNA, 19 nt, synthetic construct
  source 1..19: mol_type = other RNA
nccactactccccagctga

SEQ ID NO: 433 - RNA, 19 nt, synthetic construct
  source 1..19: mol_type = other RNA
tccactactccccagctgn

SEQ ID NO: 434 - RNA, 19 nt, synthetic construct
  source 1..19: mol_type = other RNA
nccactactccccagctgn

SEQ ID NO: 435 - RNA, 19 nt, synthetic construct
  source 1..19: mol_type = other RNA
tccactactccccagctga

SEQ ID NO: 436 - RNA, 19 nt, synthetic construct
  source 1..19: mol_type = other RNA
nccactactccccagctga

SEQ ID NO: 437 - RNA, 19 nt, synthetic construct
  source 1..19: mol_type = other RNA
tccactactccccagctgn

SEQ ID NO: 438 - RNA, 19 nt, synthetic construct
  source 1..19: mol_type = other RNA
nccactactccccagctgn

SEQ ID NO: 439 - RNA, 19 nt, synthetic construct
  source 1..19: mol_type = other RNA
gacatccactactccccag

SEQ ID NO: 440 - RNA, 19 nt, synthetic construct
  source 1..19: mol_type = other RNA
tacatccactactccccag

SEQ ID NO: 441 - RNA, 19 nt, synthetic construct
  source 1..19: mol_type = other RNA
nacatccactactccccag

SEQ ID NO: 442 - RNA, 19 nt, synthetic construct
  source 1..19: mol_type = other RNA
tacatccactactccccan

SEQ ID NO: 443 - RNA, 19 nt, synthetic construct
  source 1..19: mol_type = other RNA
nacatccactactccccan

SEQ ID NO: 444 - RNA, 19 nt, synthetic construct
  source 1..19: mol_type = other RNA
gacatccactactccccag

SEQ ID NO: 445 - RNA, 19 nt, synthetic construct
  source 1..19: mol_type = other RNA
tacatccactactccccag

SEQ ID NO: 446 - RNA, 19 nt, synthetic construct
  source 1..19: mol_type = other RNA
nacatccactactccccag

SEQ ID NO: 447 - RNA, 19 nt, synthetic construct
  source 1..19: mol_type = other RNA
tacatccactactccccan

SEQ ID NO: 448 - RNA, 19 nt, synthetic construct
  source 1..19: mol_type = other RNA
nacatccactactccccan

SEQ ID NO: 449 - RNA, 19 nt, synthetic construct
  source 1..19: mol_type = other RNA
cagacatccactactcccc

SEQ ID NO: 450 - RNA, 19 nt, synthetic construct
  source 1..19: mol_type = other RNA
tagacatccactactcccc

SEQ ID NO: 451 - RNA, 19 nt, synthetic construct
  source 1..19: mol_type = other RNA
nagacatccactactcccc

SEQ ID NO: 452 - RNA, 19 nt, synthetic construct
  source 1..19: mol_type = other RNA
tagacatccactactcccn

SEQ ID NO: 453 - RNA, 19 nt, synthetic construct
  source 1..19: mol_type = other RNA
nagacatccactactcccn

SEQ ID NO: 454 - RNA, 19 nt, synthetic construct
  source 1..19: mol_type = other RNA
aacccaaatcctcatcttg

SEQ ID NO: 455 - RNA, 19 nt, synthetic construct
  source 1..19: mol_type = other RNA
tacccaaatcctcatcttg

SEQ ID NO: 456 - RNA, 19 nt, synthetic construct
  source 1..19: mol_type = other RNA
nacccaaatcctcatcttg

SEQ ID NO: 457 - RNA, 19 nt, synthetic construct
  source 1..19: mol_type = other RNA
aacccaaatcctcatcttn

SEQ ID NO: 458 - RNA, 19 nt, synthetic construct
  source 1..19: mol_type = other RNA
nacccaaatcctcatcttn

SEQ ID NO: 459 - RNA, 19 nt, synthetic construct
  source 1..19: mol_type = other RNA
aacccaaatcctcatcttg

SEQ ID NO: 460 - RNA, 19 nt, synthetic construct
  source 1..19: mol_type = other RNA
tacccaaatcctcatcttg

SEQ ID NO: 461 - RNA, 19 nt, synthetic construct
  source 1..19: mol_type = other RNA
nacccaaatcctcatcttg

SEQ ID NO: 462 - RNA, 19 nt, synthetic construct
  source 1..19: mol_type = other RNA
aacccaaatcctcatcttn

SEQ ID NO: 463 - RNA, 19 nt, synthetic construct
  source 1..19: mol_type = other RNA
nacccaaatcctcatcttn

SEQ ID NO: 464 - RNA, 19 nt, synthetic construct
  source 1..19: mol_type = other RNA
aaacccaaatcctcatctt

SEQ ID NO: 465 - RNA, 19 nt, synthetic construct
  source 1..19: mol_type = other RNA
taacccaaatcctcatctt

SEQ ID NO: 466 - RNA, 19 nt, synthetic construct
  source 1..19: mol_type = other RNA
naacccaaatcctcatctt

SEQ ID NO: 467 - RNA, 19 nt, synthetic construct
  source 1..19: mol_type = other RNA
aaacccaaatcctcatctn

SEQ ID NO: 468 - RNA, 19 nt, synthetic construct
  source 1..19: mol_type = other RNA
naacccaaatcctcatctn

SEQ ID NO: 469 - RNA, 19 nt, synthetic construct
  source 1..19: mol_type = other RNA
aaacccaaatcctcatctt

SEQ ID NO: 470 - RNA, 19 nt, synthetic construct
  source 1..19: mol_type = other RNA
taacccaaatcctcatctt

SEQ ID NO: 471 - RNA, 19 nt, synthetic construct
  source 1..19: mol_type = other RNA
naacccaaatcctcatctt

SEQ ID NO: 472 - RNA, 19 nt, synthetic construct
  source 1..19: mol_type = other RNA
aaacccaaatcctcatctn

SEQ ID NO: 473 - RNA, 19 nt, synthetic construct
  source 1..19: mol_type = other RNA
naacccaaatcctcatctn

SEQ ID NO: 474 - RNA, 19 nt, synthetic construct
  source 1..19: mol_type = other RNA
tagaaaacccaaatcctca

SEQ ID NO: 475 - RNA, 19 nt, synthetic construct
  source 1..19: mol_type = other RNA
nagaaaacccaaatcctca

SEQ ID NO: 476 - RNA, 19 nt, synthetic construct
  source 1..19: mol_type = other RNA
tagaaaacccaaatcctcn

SEQ ID NO: 477 - RNA, 19 nt, synthetic construct
  source 1..19: mol_type = other RNA
nagaaaacccaaatcctcn

SEQ ID NO: 478 - RNA, 19 nt, synthetic construct
  source 1..19: mol_type = other RNA
cgtgtgtccttctggcttc

SEQ ID NO: 479 - RNA, 19 nt, synthetic construct
  source 1..19: mol_type = other RNA
cgtgtgtccttctggctta

SEQ ID NO: 480 - RNA, 19 nt, synthetic construct
  source 1..19: mol_type = other RNA
cgtgtgtccttctggcttn

SEQ ID NO: 481 - RNA, 19 nt, synthetic construct
  source 1..19: mol_type = other RNA
ngtgtgtccttctggctta

SEQ ID NO: 482 - RNA, 19 nt, synthetic construct
  source 1..19: mol_type = other RNA
ngtgtgtccttctggcttn

SEQ ID NO: 483 - RNA, 19 nt, synthetic construct
  modified_base 15: mod_base = i
  source 1..19: mol_type = other RNA
cgtgtgtccttctgncttc

SEQ ID NO: 484 - RNA, 19 nt, synthetic construct
  modified_base 15: mod_base = i
  source 1..19: mol_type = other RNA
cgtgtgtccttctgnctta

SEQ ID NO: 485 - RNA, 19 nt, synthetic construct
  modified_base 15: mod_base = i
  source 1..19: mol_type = other RNA
cgtgtgtccttctgncttn

SEQ ID NO: 486 - RNA, 19 nt, synthetic construct
  modified_base 15: mod_base = i
  source 1..19: mol_type = other RNA
ngtgtgtccttctgnctta

SEQ ID NO: 487 - RNA, 19 nt, synthetic construct
  modified_base 15: mod_base = i
  source 1..19: mol_type = other RNA
ngtgtgtccttctgncttn

SEQ ID NO: 488 - RNA, 19 nt, synthetic construct
  source 1..19: mol_type = other RNA
tgagtgatgagatctcttt

SEQ ID NO: 489 - RNA, 19 nt, synthetic construct
  source 1..19: mol_type = other RNA
tgagtgatgagatctctta

SEQ ID NO: 490 - RNA, 19 nt, synthetic construct
  source 1..19: mol_type = other RNA
tgagtgatgagatctcttn

SEQ ID NO: 491 - RNA, 19 nt, synthetic construct
  source 1..19: mol_type = other RNA
ngagtgatgagatctcttt

SEQ ID NO: 492 - RNA, 19 nt, synthetic construct
  source 1..19: mol_type = other RNA
ngagtgatgagatctctta

SEQ ID NO: 493 - RNA, 19 nt, synthetic construct
  source 1..19: mol_type = other RNA
ngagtgatgagatctcttn

SEQ ID NO: 494 - RNA, 19 nt, synthetic construct
  source 1..19: mol_type = other RNA
agtgatgagatctctttcc

SEQ ID NO: 495 - RNA, 19 nt, synthetic construct
  source 1..19: mol_type = other RNA
agtgatgagatctctttca

SEQ ID NO: 496 - RNA, 19 nt, synthetic construct
  source 1..19: mol_type = other RNA
agtgatgagatctctttcn

SEQ ID NO: 497 - RNA, 19 nt, synthetic construct
  source 1..19: mol_type = other RNA
ngtgatgagatctctttca

SEQ ID NO: 498 - RNA, 19 nt, synthetic construct
  source 1..19: mol_type = other RNA
ngtgatgagatctctttcn

SEQ ID NO: 499 - RNA, 19 nt, synthetic construct
  source 1..19: mol_type = other RNA
ctgctatgacggttacact

SEQ ID NO: 500 - RNA, 19 nt, synthetic construct
  source 1..19: mol_type = other RNA
ctgctatgacggttacaca

SEQ ID NO: 501 - RNA, 19 nt, synthetic construct
  source 1..19: mol_type = other RNA
ctgctatgacggttacacn

SEQ ID NO: 502 - RNA, 19 nt, synthetic construct
  source 1..19: mol_type = other RNA
ntgctatgacggttacact

SEQ ID NO: 503 - RNA, 19 nt, synthetic construct
  source 1..19: mol_type = other RNA
ntgctatgacggttacaca

SEQ ID NO: 504 - RNA, 19 nt, synthetic construct
  source 1..19: mol_type = other RNA
ntgctatgacggttacacn

SEQ ID NO: 505 - RNA, 19 nt, synthetic construct
  source 1..19: mol_type = other RNA
gccaagactccttcatgta

SEQ ID NO: 506 - RNA, 19 nt, synthetic construct
  source 1..19: mol_type = other RNA
gccaagactccttcatgtn

SEQ ID NO: 507 - RNA, 19 nt, synthetic construct
  source 1..19: mol_type = other RNA
nccaagactccttcatgta

SEQ ID NO: 508 - RNA, 19 nt, synthetic construct
  source 1..19: mol_type = other RNA
nccaagactccttcatgtn

SEQ ID NO: 509 - RNA, 19 nt, synthetic construct
  source 1..19: mol_type = other RNA
aagactccttcatgtacga

SEQ ID NO: 510 - RNA, 19 nt, synthetic construct
  source 1..19: mol_type = other RNA
aagactccttcatgtacgn

SEQ ID NO: 511 - RNA, 19 nt, synthetic construct
  source 1..19: mol_type = other RNA
nagactccttcatgtacga

SEQ ID NO: 512 - RNA, 19 nt, synthetic construct
  source 1..19: mol_type = other RNA
nagactccttcatgtacgn

SEQ ID NO: 513 - RNA, 19 nt, synthetic construct
  modified_base 18: mod_base = i
  source 1..19: mol_type = other RNA
aagactccttcatgtacna

SEQ ID NO: 514 - RNA, 19 nt, synthetic construct
  modified_base 18: mod_base = i
  source 1..19: mol_type = other RNA
aagactccttcatgtacnn

SEQ ID NO: 515 - RNA, 19 nt, synthetic construct
  modified_base 18: mod_base = i
  source 1..19: mol_type = other RNA
nagactccttcatgtacna

SEQ ID NO: 516 - RNA, 19 nt, synthetic construct
  modified_base 18: mod_base = i
  source 1..19: mol_type = other RNA
nagactccttcatgtacnn

SEQ ID NO: 517 - RNA, 19 nt, synthetic construct
  source 1..19: mol_type = other RNA
actccttcatgtacgacac

SEQ ID NO: 518 - RNA, 19 nt, synthetic construct
  source 1..19: mol_type = other RNA
actccttcatgtacgacaa

SEQ ID NO: 519 - RNA, 19 nt, synthetic construct
  source 1..19: mol_type = other RNA
actccttcatgtacgacan

SEQ ID NO: 520 - RNA, 19 nt, synthetic construct
  source 1..19: mol_type = other RNA
nctccttcatgtacgacaa

SEQ ID NO: 521 - RNA, 19 nt, synthetic construct
  source 1..19: mol_type = other RNA
nctccttcatgtacgacan

SEQ ID NO: 522 - RNA, 19 nt, synthetic construct
  modified_base 15: mod_base = i
  source 1..19: mol_type = other RNA
actccttcatgtacnacac

SEQ ID NO: 523 - RNA, 19 nt, synthetic construct
  modified_base 15: mod_base = i
  source 1..19: mol_type = other RNA
actccttcatgtacnacaa

SEQ ID NO: 524 - RNA, 19 nt, synthetic construct
  modified_base 15: mod_base = i
  source 1..19: mol_type = other RNA
actccttcatgtacnacan

SEQ ID NO: 525 - RNA, 19 nt, synthetic construct
  modified_base 15: mod_base = i
  source 1..19: mol_type = other RNA
nctccttcatgtacnacaa

SEQ ID NO: 526 - RNA, 19 nt, synthetic construct
  modified_base 15: mod_base = i
  source 1..19: mol_type = other RNA
nctccttcatgtacnacan

SEQ ID NO: 527 - RNA, 19 nt, synthetic construct
  source 1..19: mol_type = other RNA
gaccatagaaggagtcgat

SEQ ID NO: 528 - RNA, 19 nt, synthetic construct
  source 1..19: mol_type = other RNA
gaccatagaaggagtcgaa

SEQ ID NO: 529 - RNA, 19 nt, synthetic construct
  source 1..19: mol_type = other RNA
gaccatagaaggagtcgan

SEQ ID NO: 530 - RNA, 19 nt, synthetic construct
  source 1..19: mol_type = other RNA
naccatagaaggagtcgat

SEQ ID NO: 531 - RNA, 19 nt, synthetic construct
  source 1..19: mol_type = other RNA
naccatagaaggagtcgan

SEQ ID NO: 532 - RNA, 19 nt, synthetic construct
  modified_base 14: mod_base = i
  source 1..19: mol_type = other RNA
gaccatagaaggantcgat

SEQ ID NO: 533 - RNA, 19 nt, synthetic construct
  modified_base 14: mod_base = i
  source 1..19: mol_type = other RNA
gaccatagaaggantcgan

SEQ ID NO: 534 - RNA, 19 nt, synthetic construct
  modified_base 14: mod_base = i
  source 1..19: mol_type = other RNA
naccatagaaggantcgat

SEQ ID NO: 535 - RNA, 19 nt, synthetic construct
  modified_base 14: mod_base = i
  source 1..19: mol_type = other RNA
naccatagaaggantcgan

SEQ ID NO: 536 - RNA, 19 nt, synthetic construct
  source 1..19: mol_type = other RNA
tccatgaacatctacctgg

SEQ ID NO: 537 - RNA, 19 nt, synthetic construct
  source 1..19: mol_type = other RNA
tccatgaacatctacctga

SEQ ID NO: 538 - RNA, 19 nt, synthetic construct
  source 1..19: mol_type = other RNA
tccatgaacatctacctgn

SEQ ID NO: 539 - RNA, 19 nt, synthetic construct
  source 1..19: mol_type = other RNA
nccatgaacatctacctga

SEQ ID NO: 540 - RNA, 19 nt, synthetic construct
  source 1..19: mol_type = other RNA
nccatgaacatctacctgn

SEQ ID NO: 541 - RNA, 19 nt, synthetic construct
  modified_base 18: mod_base = i
  source 1..19: mol_type = other RNA
tccatgaacatctacctng

SEQ ID NO: 542 - RNA, 19 nt, synthetic construct
  modified_base 18: mod_base = i
  source 1..19: mol_type = other RNA
tccatgaacatctacctna

SEQ ID NO: 543 - RNA, 19 nt, synthetic construct
  modified_base 18: mod_base = i
  source 1..19: mol_type = other RNA
tccatgaacatctacctnn

SEQ ID NO: 544 - RNA, 19 nt, synthetic construct
  modified_base 18: mod_base = i
  source 1..19: mol_type = other RNA
nccatgaacatctacctna

SEQ ID NO: 545 - RNA, 19 nt, synthetic construct
  modified_base 18: mod_base = i
  source 1..19: mol_type = other RNA
nccatgaacatctacctnn

SEQ ID NO: 546 - RNA, 19 nt, synthetic construct
  source 1..19: mol_type = other RNA
acatctacctggtgctaga

SEQ ID NO: 547 - RNA, 19 nt, synthetic construct
  source 1..19: mol_type = other RNA
acatctacctggtgctagn

SEQ ID NO: 548 - RNA, 19 nt, synthetic construct
  source 1..19: mol_type = other RNA
ncatctacctggtgctaga

SEQ ID NO: 549 - RNA, 19 nt, synthetic construct
  source 1..19: mol_type = other RNA
ncatctacctggtgctagn

SEQ ID NO: 550 - RNA, 19 nt, synthetic construct
  modified_base 14: mod_base = i
  source 1..19: mol_type = other RNA
acatctacctggtnctaga

SEQ ID NO: 551 - RNA, 19 nt, synthetic construct
  modified_base 14: mod_base = i
  source 1..19: mol_type = other RNA
acatctacctggtnctagn

SEQ ID NO: 552 - RNA, 19 nt, synthetic construct
  modified_base 14: mod_base = i
  source 1..19: mol_type = other RNA
ncatctacctggtnctaga

SEQ ID NO: 553 - RNA, 19 nt, synthetic construct
  modified_base 14: mod_base = i
  source 1..19: mol_type = other RNA
ncatctacctggtnctagn

SEQ ID NO: 554 - RNA, 19 nt, synthetic construct
  source 1..19: mol_type = other RNA
atctacctggtgctagatg

SEQ ID NO: 555 - RNA, 19 nt, synthetic construct
  source 1..19: mol_type = other RNA
atctacctggtgctagatg

SEQ ID NO: 556 - RNA, 19 nt, synthetic construct
  source 1..19: mol_type = other RNA
atctacctggtgctagatn

SEQ ID NO: 557 - RNA, 19 nt, synthetic construct
  source 1..19: mol_type = other RNA
ntctacctggtgctagatg

SEQ ID NO: 558 - RNA, 19 nt, synthetic construct
  source 1..19: mol_type = other RNA
ntctacctggtgctagatn

SEQ ID NO: 559 - RNA, 19 nt, synthetic construct
  source 1..19: mol_type = other RNA
tctacctggtgctagatgg

SEQ ID NO: 560 - RNA, 19 nt, synthetic construct
  source 1..19: mol_type = other RNA
tctacctggtgctagatga

SEQ ID NO: 561 - RNA, 19 nt, synthetic construct
  source 1..19: mol_type = other RNA
tctacctggtgctagatgn

SEQ ID NO: 562 - RNA, 19 nt, synthetic construct
  source 1..19: mol_type = other RNA
nctacctggtgctagatga

SEQ ID NO: 563 - RNA, 19 nt, synthetic construct
  source 1..19: mol_type = other RNA
nctacctggtgctagatgn

SEQ ID NO: 564 - RNA, 19 nt, synthetic construct
  source 1..19: mol_type = other RNA
ctacctggtgctagatgga

SEQ ID NO: 565 - RNA, 19 nt, synthetic construct
  source 1..19: mol_type = other RNA
ctacctggtgctagatggn

SEQ ID NO: 566 - RNA, 19 nt, synthetic construct
  source 1..19: mol_type = other RNA
ntacctggtgctagatgga

SEQ ID NO: 567 - RNA, 19 nt, synthetic construct
  source 1..19: mol_type = other RNA
ntacctggtgctagatggn

SEQ ID NO: 568 - RNA, 19 nt, synthetic construct
  modified_base 17: mod_base = i
  source 1..19: mol_type = other RNA
ctacctggtgctagatnga

SEQ ID NO: 569 - RNA, 19 nt, synthetic construct
  modified_base 17: mod_base = i
  source 1..19: mol_type = other RNA
ctacctggtgctagatngn

SEQ ID NO: 570 - RNA, 19 nt, synthetic construct
  modified_base 17: mod_base = i
  source 1..19: mol_type = other RNA
ntacctggtgctagatnga

SEQ ID NO: 571 - RNA, 19 nt, synthetic construct
  modified_base 17: mod_base = i
  source 1..19: mol_type = other RNA
ntacctggtgctagatngn

SEQ ID NO: 572 - RNA, 19 nt, synthetic construct
  source 1..19: mol_type = other RNA
tacctggtgctagatggat

SEQ ID NO: 573 - RNA, 19 nt, synthetic construct
  source 1..19: mol_type = other RNA
tacctggtgctagatggaa

SEQ ID NO: 574 - RNA, 19 nt, synthetic construct
  source 1..19: mol_type = other RNA
tacctggtgctagatggan

SEQ ID NO: 575 - RNA, 19 nt, synthetic construct
  source 1..19: mol_type = other RNA
nacctggtgctagatggat

SEQ ID NO: 576 - RNA, 19 nt, synthetic construct
  source 1..19: mol_type = other RNA
nacctggtgctagatggan

SEQ ID NO: 577 - RNA, 19 nt, synthetic construct
  modified_base 16: mod_base = i
  source 1..19: mol_type = other RNA
tacctggtgctagatngat

SEQ ID NO: 578 - RNA, 19 nt, synthetic construct
  modified_base 16: mod_base = i
  source 1..19: mol_type = other RNA
tacctggtgctagatngaa

SEQ ID NO: 579 - RNA, 19 nt, synthetic construct
  modified_base 16: mod_base = i
  source 1..19: mol_type = other RNA
tacctggtgctagatngan

SEQ ID NO: 580 - RNA, 19 nt, synthetic construct
  modified_base 16: mod_base = i
  source 1..19: mol_type = other RNA
nacctggtgctagatngat

SEQ ID NO: 581 - RNA, 19 nt, synthetic construct
  modified_base 16: mod_base = i
  source 1..19: mol_type = other RNA
nacctggtgctagatngan

SEQ ID NO: 582 - RNA, 19 nt, synthetic construct
  source 1..19: mol_type = other RNA
cctggtgctagatggatca

SEQ ID NO: 583 - RNA, 19 nt, synthetic construct
  source 1..19: mol_type = other RNA
cctggtgctagatggatcn

SEQ ID NO: 584 - RNA, 19 nt, synthetic construct
  source 1..19: mol_type = other RNA
nctggtgctagatggatca

SEQ ID NO: 585 - RNA, 19 nt, synthetic construct
  source 1..19: mol_type = other RNA
nctggtgctagatggatcn

SEQ ID NO: 586 - RNA, 19 nt, synthetic construct
  modified_base 15: mod_base = i
  source 1..19: mol_type = other RNA
cctggtgctagatgnatca

SEQ ID NO: 587 - RNA, 19 nt, synthetic construct
  modified_base 15: mod_base = i
  source 1..19: mol_type = other RNA
cctggtgctagatgnatcn

SEQ ID NO: 588 - RNA, 19 nt, synthetic construct
  modified_base 15: mod_base = i
  source 1..19: mol_type = other RNA
nctggtgctagatgnatca

SEQ ID NO: 589 - RNA, 19 nt, synthetic construct
  modified_base 15: mod_base = i
  source 1..19: mol_type = other RNA
nctggtgctagatgnatcn

SEQ ID NO: 590 - RNA, 19 nt, synthetic construct
  source 1..19: mol_type = other RNA
gtgctagatggatcagaca

SEQ ID NO: 591 - RNA, 19 nt, synthetic construct
  source 1..19: mol_type = other RNA
gtgctagatggatcagacn

SEQ ID NO: 592 - RNA, 19 nt, synthetic construct
  source 1..19: mol_type = other RNA
ntgctagatggatcagaca

SEQ ID NO: 593 - RNA, 19 nt, synthetic construct
  source 1..19: mol_type = other RNA
ntgctagatggatcagacn

SEQ ID NO: 594 - RNA, 19 nt, synthetic construct
  modified_base 16: mod_base = i
  source 1..19: mol_type = other RNA
gtgctagatggatcanaca

SEQ ID NO: 595 - RNA, 19 nt, synthetic construct
  modified_base 16: mod_base = i
  source 1..19: mol_type = other RNA
gtgctagatggatcanacn

SEQ ID NO: 596 - RNA, 19 nt, synthetic construct
  modified_base 16: mod_base = i
  source 1..19: mol_type = other RNA
ntgctagatggatcanaca

SEQ ID NO: 597 - RNA, 19 nt, synthetic construct
  modified_base 16: mod_base = i
  source 1..19: mol_type = other RNA
ntgctagatggatcanacn

SEQ ID NO: 598 - RNA, 19 nt, synthetic construct
  source 1..19: mol_type = other RNA
tagatggatcagacagcat

SEQ ID NO: 599 - RNA, 19 nt, synthetic construct
  source 1..19: mol_type = other RNA
tagatggatcagacagcaa

SEQ ID NO: 600 - RNA, 19 nt, synthetic construct
  source 1..19: mol_type = other RNA
tagatggatcagacagcan

SEQ ID NO: 601 - RNA, 19 nt, synthetic construct
  source 1..19: mol_type = other RNA
nagatggatcagacagcat

SEQ ID NO: 602 - RNA, 19 nt, synthetic construct
  source 1..19: mol_type = other RNA
nagatggatcagacagcan

SEQ ID NO: 603 - RNA, 19 nt, synthetic construct
  source 1..19: mol_type = other RNA
tagatggatcagacagcat

SEQ ID NO: 604 - RNA, 19 nt, synthetic construct
  modified_base 16: mod_base = i
  source 1..19: mol_type = other RNA
tagatggatcagacancaa

SEQ ID NO: 605 - RNA, 19 nt, synthetic construct
  modified_base 16: mod_base = i
  source 1..19: mol_type = other RNA
tagatggatcagacancan

SEQ ID NO: 606 - RNA, 19 nt, synthetic construct
  modified_base 16: mod_base = i
  source 1..19: mol_type = other RNA
nagatggatcagacancat

SEQ ID NO: 607 - RNA, 19 nt, synthetic construct
  modified_base 16: mod_base = i
  source 1..19: mol_type = other RNA
nagatggatcagacancan

SEQ ID NO: 608 - RNA, 19 nt, synthetic construct
  source 1..19: mol_type = other RNA
ggatcagacagcattgggg

SEQ ID NO: 609 - RNA, 19 nt, synthetic construct
  source 1..19: mol_type = other RNA
ggatcagacagcattggga

SEQ ID NO: 610 - RNA, 19 nt, synthetic construct
  source 1..19: mol_type = other RNA
ggatcagacagcattgggn

SEQ ID NO: 611 - RNA, 19 nt, synthetic construct
  source 1..19: mol_type = other RNA
ngatcagacagcattggga

SEQ ID NO: 612 - RNA, 19 nt, synthetic construct
  source 1..19: mol_type = other RNA
ngatcagacagcattgggn

SEQ ID NO: 613 - RNA, 19 nt, synthetic construct
  modified_base 17: mod_base = i
  source 1..19: mol_type = other RNA
ggatcagacagcattgngg

SEQ ID NO: 614 - RNA, 19 nt, synthetic construct
  modified_base 17: mod_base = i
  source 1..19: mol_type = other RNA
ggatcagacagcattgnga

SEQ ID NO: 615 - RNA, 19 nt, synthetic construct
  modified_base 17: mod_base = i
  source 1..19: mol_type = other RNA
ggatcagacagcattgngn

SEQ ID NO: 616 - RNA, 19 nt, synthetic construct
  modified_base 17: mod_base = i
  source 1..19: mol_type = other RNA
ngatcagacagcattgnga

SEQ ID NO: 617 - RNA, 19 nt, synthetic construct
  modified_base 17: mod_base = i
  source 1..19: mol_type = other RNA
ngatcagacagcattgngn

SEQ ID NO: 618 - RNA, 19 nt, synthetic construct
  source 1..19: mol_type = other RNA
gccaaaaagtgtctagtca

SEQ ID NO: 619 - RNA, 19 nt, synthetic construct
  source 1..19: mol_type = other RNA
gccaaaaagtgtctagtcn

SEQ ID NO: 620 - RNA, 19 nt, synthetic construct
  source 1..19: mol_type = other RNA
nccaaaaagtgtctagtca

SEQ ID NO: 621 - RNA, 19 nt, synthetic construct
  source 1..19: mol_type = other RNA
nccaaaaagtgtctagtcn

SEQ ID NO: 622 - RNA, 19 nt, synthetic construct
  modified_base 16: mod_base = i
  source 1..19: mol_type = other RNA
gccaaaaagtgtctantca

SEQ ID NO: 623 - RNA, 19 nt, synthetic construct
  modified_base 16: mod_base = i
  source 1..19: mol_type = other RNA
gccaaaaagtgtctantcn

SEQ ID NO: 624 - RNA, 19 nt, synthetic construct
  modified_base 16: mod_base = i
  source 1..19: mol_type = other RNA
nccaaaaagtgtctantca

SEQ ID NO: 625 - RNA, 19 nt, synthetic construct
  modified_base 16: mod_base = i
  source 1..19: mol_type = other RNA
nccaaaaagtgtctantcn

SEQ ID NO: 626 - RNA, 19 nt, synthetic construct
  source 1..19: mol_type = other RNA
caaaaagtgtctagtcaac

SEQ ID NO: 627 - RNA, 19 nt, synthetic construct
  source 1..19: mol_type = other RNA
caaaaagtgtctagtcaaa

SEQ ID NO: 628 - RNA, 19 nt, synthetic construct
  source 1..19: mol_type = other RNA
caaaaagtgtctagtcaan

SEQ ID NO: 629 - RNA, 19 nt, synthetic construct
  source 1..19: mol_type = other RNA
naaaaagtgtctagtcaaa

SEQ ID NO: 630 - RNA, 19 nt, synthetic construct
  source 1..19: mol_type = other RNA
naaaaagtgtctagtcaan

SEQ ID NO: 631 - RNA, 19 nt, synthetic construct
  source 1..19: mol_type = other RNA
aaaagtgtctagtcaactt

SEQ ID NO: 632 - RNA, 19 nt, synthetic construct
  source 1..19: mol_type = other RNA
aaaagtgtctagtcaacta

SEQ ID NO: 633 - RNA, 19 nt, synthetic construct
  source 1..19: mol_type = other RNA
aaaagtgtctagtcaactn

SEQ ID NO: 634 - RNA, 19 nt, synthetic construct
  source 1..19: mol_type = other RNA
naaagtgtctagtcaactt

SEQ ID NO: 635 - RNA, 19 nt, synthetic construct
  source 1..19: mol_type = other RNA
naaagtgtctagtcaactn

SEQ ID NO: 636 - RNA, 19 nt, synthetic construct
  source 1..19: mol_type = other RNA
gaaggtggcaagttatggt

SEQ ID NO: 637 - RNA, 19 nt, synthetic construct
  source 1..19: mol_type = other RNA
gaaggtggcaagttatgga

SEQ ID NO: 638 - RNA, 19 nt, synthetic construct
  source 1..19: mol_type = other RNA
gaaggtggcaagttatggn

SEQ ID NO: 639 - RNA, 19 nt, synthetic construct
  source 1..19: mol_type = other RNA
naaggtggcaagttatggt

SEQ ID NO: 640 - RNA, 19 nt, synthetic construct
  source 1..19: mol_type = other RNA
naaggtggcaagttatggn

SEQ ID NO: 641 - RNA, 19 nt, synthetic construct
  source 1..19: mol_type = other RNA
aaggtggcaagttatggtg

SEQ ID NO: 642 - RNA, 19 nt, synthetic construct
  source 1..19: mol_type = other RNA
aaggtggcaagttatggta

SEQ ID NO: 643 - RNA, 19 nt, synthetic construct
  source 1..19: mol_type = other RNA
aaggtggcaagttatggtn

SEQ ID NO: 644 - RNA, 19 nt, synthetic construct
  source 1..19: mol_type = other RNA
naggtggcaagttatggta

SEQ ID NO: 645 - RNA, 19 nt, synthetic construct
  source 1..19: mol_type = other RNA
naggtggcaagttatggtn

SEQ ID NO: 646 - RNA, 19 nt, synthetic construct
  source 1..19: mol_type = other RNA
gttatggtgtgaagccaag

SEQ ID NO: 647 - RNA, 19 nt, synthetic construct
  source 1..19: mol_type = other RNA
gttatggtgtgaagccaaa

SEQ ID NO: 648 - RNA, 19 nt, synthetic construct
  source 1..19: mol_type = other RNA
gttatggtgtgaagccaan

SEQ ID NO: 649 - RNA, 19 nt, synthetic construct
  source 1..19: mol_type = other RNA
nttatggtgtgaagccaaa

SEQ ID NO: 650 - RNA, 19 nt, synthetic construct
  source 1..19: mol_type = other RNA
nttatggtgtgaagccaan

SEQ ID NO: 651 - RNA, 19 nt, synthetic construct
  modified_base 14: mod_base = i
  source 1..19: mol_type = other RNA
gttatggtgtgaanccaag

SEQ ID NO: 652 - RNA, 19 nt, synthetic construct
  modified_base 14: mod_base = i
  source 1..19: mol_type = other RNA
gttatggtgtgaanccaaa

SEQ ID NO: 653 - RNA, 19 nt, synthetic construct
  modified_base 14: mod_base = i
  source 1..19: mol_type = other RNA
gttatggtgtgaanccaan

SEQ ID NO: 654 - RNA, 19 nt, synthetic construct
  modified_base 14: mod_base = i
  source 1..19: mol_type = other RNA
nttatggtgtgaanccaaa

SEQ ID NO: 655 - RNA, 19 nt, synthetic construct
  modified_base 14: mod_base = i
  source 1..19: mol_type = other RNA
nttatggtgtgaanccaan

SEQ ID NO: 656 - RNA, 19 nt, synthetic construct
  source 1..19: mol_type = other RNA
gcagtgtacagcatgatga

SEQ ID NO: 657 - RNA, 19 nt, synthetic construct
  source 1..19: mol_type = other RNA
gcagtgtacagcatgatgn

SEQ ID NO: 658 - RNA, 19 nt, synthetic construct
  source 1..19: mol_type = other RNA
ncagtgtacagcatgatga

SEQ ID NO: 659 - RNA, 19 nt, synthetic construct
  source 1..19: mol_type = other RNA
ncagtgtacagcatgatgn

SEQ ID NO: 660 - RNA, 19 nt, synthetic construct
  source 1..19: mol_type = other RNA
gatggattgcacaacatgg

SEQ ID NO: 661 - RNA, 19 nt, synthetic construct
  source 1..19: mol_type = other RNA
gatggattgcacaacatga

SEQ ID NO: 662 - RNA, 19 nt, synthetic construct
  source 1..19: mol_type = other RNA
gatggattgcacaacatgn

SEQ ID NO: 663 - RNA, 19 nt, synthetic construct
  source 1..19: mol_type = other RNA
natggattgcacaacatga

SEQ ID NO: 664 - RNA, 19 nt, synthetic construct
  source 1..19: mol_type = other RNA
natggattgcacaacatgn

SEQ ID NO: 665 - RNA, 19 nt, synthetic construct
  source 1..19: mol_type = other RNA
acccaattactgtcattga

SEQ ID NO: 666 - RNA, 19 nt, synthetic construct
  source 1..19: mol_type = other RNA
acccaattactgtcattgn

SEQ ID NO: 667 - RNA, 19 nt, synthetic construct
  source 1..19: mol_type = other RNA
ncccaattactgtcattga

SEQ ID NO: 668 - RNA, 19 nt, synthetic construct
  source 1..19: mol_type = other RNA
ncccaattactgtcattgn

SEQ ID NO: 669 - RNA, 19 nt, synthetic construct
  source 1..19: mol_type = other RNA
cccaattactgtcattgat

SEQ ID NO: 670 - RNA, 19 nt, synthetic construct
  source 1..19: mol_type = other RNA
cccaattactgtcattgaa

SEQ ID NO: 671 - RNA, 19 nt, synthetic construct
  source 1..19: mol_type = other RNA
cccaattactgtcattgan

SEQ ID NO: 672 - RNA, 19 nt, synthetic construct
  source 1..19: mol_type = other RNA
nccaattactgtcattgat

SEQ ID NO: 673 - RNA, 19 nt, synthetic construct
  source 1..19: mol_type = other RNA
nccaattactgtcattgan

SEQ ID NO: 674 - RNA, 19 nt, synthetic construct
  source 1..19: mol_type = other RNA
caattactgtcattgatga

SEQ ID NO: 675 - RNA, 19 nt, synthetic construct
  source 1..19: mol_type = other RNA
caattactgtcattgatga

SEQ ID NO: 676 - RNA, 19 nt, synthetic construct
  source 1..19: mol_type = other RNA
naattactgtcattgatga

SEQ ID NO: 677 - RNA, 19 nt, synthetic construct
  source 1..19: mol_type = other RNA
naattactgtcattgatgn

SEQ ID NO: 678 - RNA, 19 nt, synthetic construct
  source 1..19: mol_type = other RNA
ctgtcattgatgagatccg

SEQ ID NO: 679 - RNA, 19 nt, synthetic construct
  source 1..19: mol_type = other RNA
ctgtcattgatgagatcca

SEQ ID NO: 680 - RNA, 19 nt, synthetic construct
  source 1..19: mol_type = other RNA
ctgtcattgatgagatccn

SEQ ID NO: 681 - RNA, 19 nt, synthetic construct
  source 1..19: mol_type = other RNA
ntgtcattgatgagatcca

SEQ ID NO: 682 - RNA, 19 nt, synthetic construct
  source 1..19: mol_type = other RNA
ntgtcattgatgagatccn

SEQ ID NO: 683 - RNA, 19 nt, synthetic construct
  modified_base 14: mod_base = i
  source 1..19: mol_type = other RNA
ctgtcattgatganatccg

SEQ ID NO: 684 - RNA, 19 nt, synthetic construct
  modified_base 14: mod_base = i
  source 1..19: mol_type = other RNA
ctgtcattgatganatcca

SEQ ID NO: 685 - RNA, 19 nt, synthetic construct
  modified_base 14: mod_base = i
  source 1..19: mol_type = other RNA
ctgtcattgatganatccn

SEQ ID NO: 686 - RNA, 19 nt, synthetic construct
  modified_base 14: mod_base = i
  source 1..19: mol_type = other RNA
ntgtcattgatganatcca

SEQ ID NO: 687 - RNA, 19 nt, synthetic construct
  modified_base 14: mod_base = i
  source 1..19: mol_type = other RNA
ntgtcattgatganatccn

SEQ ID NO: 688 - RNA, 19 nt, synthetic construct
  source 1..19: mol_type = other RNA
aggattatctggatgtcta

SEQ ID NO: 689 - RNA, 19 nt, synthetic construct
  source 1..19: mol_type = other RNA
aggattatctggatgtctn

SEQ ID NO: 690 - RNA, 19 nt, synthetic construct
  source 1..19: mol_type = other RNA
nggattatctggatgtcta

SEQ ID NO: 691 - RNA, 19 nt, synthetic construct
  source 1..19: mol_type = other RNA
nggattatctggatgtctn

SEQ ID NO: 692 - RNA, 19 nt, synthetic construct
  source 1..19: mol_type = other RNA
tctggatgtctatgtgttt

SEQ ID NO: 693 - RNA, 19 nt, synthetic construct
  source 1..19: mol_type = other RNA
tctggatgtctatgtgtta

SEQ ID NO: 694 - RNA, 19 nt, synthetic construct
  source 1..19: mol_type = other RNA
tctggatgtctatgtgttn

SEQ ID NO: 695 - RNA, 19 nt, synthetic construct
  source 1..19: mol_type = other RNA
nctggatgtctatgtgttt

SEQ ID NO: 696 - RNA, 19 nt, synthetic construct
  source 1..19: mol_type = other RNA
nctggatgtctatgtgttn

SEQ ID NO: 697 - RNA, 19 nt, synthetic construct
  source 1..19: mol_type = other RNA
tggatgtctatgtgtttgg

SEQ ID NO: 698 - RNA, 19 nt, synthetic construct
  source 1..19: mol_type = other RNA
tggatgtctatgtgtttga

SEQ ID NO: 699 - RNA, 19 nt, synthetic construct
  source 1..19: mol_type = other RNA
tggatgtctatgtgtttgn

SEQ ID NO: 700 - RNA, 19 nt, synthetic construct
  source 1..19: mol_type = other RNA
nggatgtctatgtgtttga

SEQ ID NO: 701 - RNA, 19 nt, synthetic construct
  source 1..19: mol_type = other RNA
nggatgtctatgtgtttgn

SEQ ID NO: 702 - RNA, 19 nt, synthetic construct
  source 1..19: mol_type = other RNA
accaagtgaacatcaatgc

SEQ ID NO: 703 - RNA, 19 nt, synthetic construct
  source 1..19: mol_type = other RNA
accaagtgaacatcaatga

SEQ ID NO: 704 - RNA, 19 nt, synthetic construct
  source 1..19: mol_type = other RNA
accaagtgaacatcaatgn

SEQ ID NO: 705 - RNA, 19 nt, synthetic construct
  source 1..19: mol_type = other RNA
nccaagtgaacatcaatga

SEQ ID NO: 706 - RNA, 19 nt, synthetic construct
  source 1..19: mol_type = other RNA
nccaagtgaacatcaatgn

SEQ ID NO: 707 - RNA, 19 nt, synthetic construct
  source 1..19: mol_type = other RNA
aagtgaacatcaatgcttt

SEQ ID NO: 708 - RNA, 19 nt, synthetic construct
  source 1..19: mol_type = other RNA
aagtgaacatcaatgctta

SEQ ID NO: 709 - RNA, 19 nt, synthetic construct
  source 1..19: mol_type = other RNA
aagtgaacatcaatgcttn

SEQ ID NO: 710 - RNA, 19 nt, synthetic construct
  source 1..19: mol_type = other RNA
nagtgaacatcaatgcttt

SEQ ID NO: 711 - RNA, 19 nt, synthetic construct
  source 1..19: mol_type = other RNA
nagtgaacatcaatgcttn

SEQ ID NO: 712 - RNA, 19 nt, synthetic construct
  source 1..19: mol_type = other RNA
gaacatcaatgctttggct

SEQ ID NO: 713 - RNA, 19 nt, synthetic construct
  source 1..19: mol_type = other RNA
gaacatcaatgctttggca

SEQ ID NO: 714 - RNA, 19 nt, synthetic construct
  source 1..19: mol_type = other RNA
gaacatcaatgctttggcn

SEQ ID NO: 715 - RNA, 19 nt, synthetic construct
  source 1..19: mol_type = other RNA
naacatcaatgctttggct

SEQ ID NO: 716 - RNA, 19 nt, synthetic construct
  source 1..19: mol_type = other RNA
naacatcaatgctttggcn

SEQ ID NO: 717 - RNA, 19 nt, synthetic construct
  modified_base 17: mod_base = i
  source 1..19: mol_type = other RNA
gaacatcaatgctttgnct

SEQ ID NO: 718 - RNA, 19 nt, synthetic construct
  modified_base 17: mod_base = i
  source 1..19: mol_type = other RNA
gaacatcaatgctttgnca

SEQ ID NO: 719 - RNA, 19 nt, synthetic construct
  modified_base 17: mod_base = i
  source 1..19: mol_type = other RNA
gaacatcaatgctttgncn

SEQ ID NO: 720 - RNA, 19 nt, synthetic construct
  modified_base 17: mod_base = i
  source 1..19: mol_type = other RNA
naacatcaatgctttgnct

SEQ ID NO: 721 - RNA, 19 nt, synthetic construct
  modified_base 17: mod_base = i
  source 1..19: mol_type = other RNA
naacatcaatgctttgncn

SEQ ID NO: 722 - RNA, 19 nt, synthetic construct
  source 1..19: mol_type = other RNA
acatcaatgctttggcttc

SEQ ID NO: 723 - RNA, 19 nt, synthetic construct
  source 1..19: mol_type = other RNA
acatcaatgctttggctta

SEQ ID NO: 724 - RNA, 19 nt, synthetic construct
  source 1..19: mol_type = other RNA
acatcaatgctttggcttn

SEQ ID NO: 725 - RNA, 19 nt, synthetic construct
  source 1..19: mol_type = other RNA
ncatcaatgctttggctta

SEQ ID NO: 726 - RNA, 19 nt, synthetic construct
  source 1..19: mol_type = other RNA
ncatcaatgctttggcttn

SEQ ID NO: 727 - RNA, 19 nt, synthetic construct
  modified_base 15: mod_base = i
  source 1..19: mol_type = other RNA
acatcaatgctttgncttc

SEQ ID NO: 728 - RNA, 19 nt, synthetic construct
  modified_base 15: mod_base = i
  source 1..19: mol_type = other RNA
acatcaatgctttgnctta

SEQ ID NO: 729 - RNA, 19 nt, synthetic construct
  modified_base 15: mod_base = i
  source 1..19: mol_type = other RNA
acatcaatgctttgncttn

SEQ ID NO: 730 - RNA, 19 nt, synthetic construct
  modified_base 15: mod_base = i
  source 1..19: mol_type = other RNA
ncatcaatgctttgnctta

SEQ ID NO: 731 - RNA, 19 nt, synthetic construct
  modified_base 15: mod_base = i
  source 1..19: mol_type = other RNA
ncatcaatgctttgncttn

SEQ ID NO: 732 - RNA, 19 nt, synthetic construct
  source 1..19: mol_type = other RNA
agaaagacaatgagcaaca

SEQ ID NO: 733 - RNA, 19 nt, synthetic construct
  source 1..19: mol_type = other RNA
agaaagacaatgagcaacn

SEQ ID NO: 734 - RNA, 19 nt, synthetic construct
  source 1..19: mol_type = other RNA
ngaaagacaatgagcaaca

SEQ ID NO: 735 - RNA, 19 nt, synthetic construct
  source 1..19: mol_type = other RNA
ngaaagacaatgagcaacn

SEQ ID NO: 736 - RNA, 19 nt, synthetic construct
  modified_base 14: mod_base = i
  source 1..19: mol_type = other RNA
agaaagacaatgancaaca

SEQ ID NO: 737 - RNA, 19 nt, synthetic construct
  modified_base 14: mod_base = i
  source 1..19: mol_type = other RNA
agaaagacaatgancaacn

SEQ ID NO: 738 - RNA, 19 nt, synthetic construct
  modified_base 14: mod_base = i
  source 1..19: mol_type = other RNA
ngaaagacaatgancaaca

SEQ ID NO: 739 - RNA, 19 nt, synthetic construct
  modified_base 14: mod_base = i
  source 1..19: mol_type = other RNA
ngaaagacaatgancaacn

SEQ ID NO: 740 - RNA, 19 nt, synthetic construct
  source 1..19: mol_type = other RNA
aagacaatgagcaacatgt

SEQ ID NO: 741 - RNA, 19 nt, synthetic construct
  source 1..19: mol_type = other RNA
aagacaatgagcaacatga

SEQ ID NO: 742 - RNA, 19 nt, synthetic construct
  source 1..19: mol_type = other RNA
aagacaatgagcaacatgn

SEQ ID NO: 743 - RNA, 19 nt, synthetic construct
  source 1..19: mol_type = other RNA
nagacaatgagcaacatgt

SEQ ID NO: 744 - RNA, 19 nt, synthetic construct
  source 1..19: mol_type = other RNA
nagacaatgagcaacatgn

SEQ ID NO: 745 - RNA, 19 nt, synthetic construct
  source 1..19: mol_type = other RNA
tctgagtctctgtggcatg

SEQ ID NO: 746 - RNA, 19 nt, synthetic construct
  source 1..19: mol_type = other RNA
tctgagtctctgtggcata

SEQ ID NO: 747 - RNA, 19 nt, synthetic construct
  source 1..19: mol_type = other RNA
tctgagtctctgtggcatn

SEQ ID NO: 748 - RNA, 19 nt, synthetic construct
  source 1..19: mol_type = other RNA
nctgagtctctgtggcata

SEQ ID NO: 749 - RNA, 19 nt, synthetic construct
  source 1..19: mol_type = other RNA
nctgagtctctgtggcatn

SEQ ID NO: 750 - RNA, 19 nt, synthetic construct
  modified_base 15: mod_base = i
  source 1..19: mol_type = other RNA
tctgagtctctgtgncatg

SEQ ID NO: 751 - RNA, 19 nt, synthetic construct
  modified_base 15: mod_base = i
  source 1..19: mol_type = other RNA
tctgagtctctgtgncata

SEQ ID NO: 752 - RNA, 19 nt, synthetic construct
  modified_base 15: mod_base = i
  source 1..19: mol_type = other RNA
tctgagtctctgtgncatn

SEQ ID NO: 753 - RNA, 19 nt, synthetic construct
  modified_base 15: mod_base = i
  source 1..19: mol_type = other RNA
nctgagtctctgtgncata

SEQ ID NO: 754 - RNA, 19 nt, synthetic construct
  modified_base 15: mod_base = i
  source 1..19: mol_type = other RNA
nctgagtctctgtgncatn

SEQ ID NO: 755 - RNA, 19 nt, synthetic construct
  source 1..19: mol_type = other RNA
taccgattaccacaagcaa

SEQ ID NO: 756 - RNA, 19 nt, synthetic construct
  source 1..19: mol_type = other RNA
taccgattaccacaagcan

SEQ ID NO: 757 - RNA, 19 nt, synthetic construct
  source 1..19: mol_type = other RNA
naccgattaccacaagcaa

SEQ ID NO: 758 - RNA, 19 nt, synthetic construct
  source 1..19: mol_type = other RNA
naccgattaccacaagcan

SEQ ID NO: 759 - RNA, 19 nt, synthetic construct
  modified_base 16: mod_base = i
  source 1..19: mol_type = other RNA
taccgattaccacaancaa

SEQ ID NO: 760 - RNA, 19 nt, synthetic construct
  modified_base 16: mod_base = i
  source 1..19: mol_type = other RNA
taccgattaccacaancan

SEQ ID NO: 761 - RNA, 19 nt, synthetic construct
  modified_base 16: mod_base = i
  source 1..19: mol_type = other RNA
naccgattaccacaancaa

SEQ ID NO: 762 - RNA, 19 nt, synthetic construct
  modified_base 16: mod_base = i
  source 1..19: mol_type = other RNA
naccgattaccacaancan

SEQ ID NO: 763 - RNA, 19 nt, synthetic construct
  source 1..19: mol_type = other RNA
ccgattaccacaagcaacc

SEQ ID NO: 764 - RNA, 19 nt, synthetic construct
  source 1..19: mol_type = other RNA
ccgattaccacaagcaaca

SEQ ID NO: 765 - RNA, 19 nt, synthetic construct
  source 1..19: mol_type = other RNA
ccgattaccacaagcaacn

SEQ ID NO: 766 - RNA, 19 nt, synthetic construct
  source 1..19: mol_type = other RNA
ncgattaccacaagcaaca

SEQ ID NO: 767 - RNA, 19 nt, synthetic construct
  source 1..19: mol_type = other RNA
ncgattaccacaagcaacn

SEQ ID NO: 768 - RNA, 19 nt, synthetic construct
  modified_base 14: mod_base = i
  source 1..19: mol_type = other RNA
ccgattaccacaancaacc

SEQ ID NO: 769 - RNA, 19 nt, synthetic construct
  modified_base 14: mod_base = i
  source 1..19: mol_type = other RNA
ccgattaccacaancaaca

SEQ ID NO: 770 - RNA, 19 nt, synthetic construct
  modified_base 14: mod_base = i
  source 1..19: mol_type = other RNA
ccgattaccacaancaacn

SEQ ID NO: 771 - RNA, 19 nt, synthetic construct
  modified_base 14: mod_base = i
  source 1..19: mol_type = other RNA
ncgattaccacaancaaca

SEQ ID NO: 772 - RNA, 19 nt, synthetic construct
  modified_base 14: mod_base = i
  source 1..19: mol_type = other RNA
ncgattaccacaancaacn

SEQ ID NO: 773 - RNA, 19 nt, synthetic construct
  source 1..19: mol_type = other RNA
tggcaggccaagatctcag

SEQ ID NO: 774 - RNA, 19 nt, synthetic construct
  source 1..19: mol_type = other RNA
tggcaggccaagatctcaa

SEQ ID NO: 775 - RNA, 19 nt, synthetic construct
  source 1..19: mol_type = other RNA
tggcaggccaagatctcan

SEQ ID NO: 776 - RNA, 19 nt, synthetic construct
  source 1..19: mol_type = other RNA
nggcaggccaagatctcaa

SEQ ID NO: 777 - RNA, 19 nt, synthetic construct
  source 1..19: mol_type = other RNA
nggcaggccaagatctcan

SEQ ID NO: 778 - RNA, 19 nt, synthetic construct
  source 1..19: mol_type = other RNA
tgtggtgtctgagtacttt

SEQ ID NO: 779 - RNA, 19 nt, synthetic construct
  source 1..19: mol_type = other RNA
tgtggtgtctgagtactta

SEQ ID NO: 780 - RNA, 19 nt, synthetic construct
  source 1..19: mol_type = other RNA
tgtggtgtctgagtactta

SEQ ID NO: 781 - RNA, 19 nt, synthetic construct
  source 1..19: mol_type = other RNA
tgtggtgtctgagtacttn

SEQ ID NO: 782 - RNA, 19 nt, synthetic construct
  source 1..19: mol_type = other RNA
ngtggtgtctgagtacttt

SEQ ID NO: 783 - RNA, 19 nt, synthetic construct
  source 1..19: mol_type = other RNA
ngtggtgtctgagtactta

SEQ ID NO: 784 - RNA, 19 nt, synthetic construct
  source 1..19: mol_type = other RNA
ngtggtgtctgagtacttn

SEQ ID NO: 785 - RNA, 19 nt, synthetic construct
  source 1..19: mol_type = other RNA
tgtggtgtctgagtacttt

SEQ ID NO: 786 - RNA, 19 nt, synthetic construct
  source 1..19: mol_type = other RNA
tgtggtgtctgagtactta

SEQ ID NO: 787 - RNA, 19 nt, synthetic construct
  source 1..19: mol_type = other RNA
tgtggtgtctgagtacttn

SEQ ID NO: 788 - RNA, 19 nt, synthetic construct
  source 1..19: mol_type = other RNA
ngtggtgtctgagtacttt

SEQ ID NO: 789 - RNA, 19 nt, synthetic construct
  source 1..19: mol_type = other RNA
ngtggtgtctgagtactta

SEQ ID NO: 790 - RNA, 19 nt, synthetic construct
  source 1..19: mol_type = other RNA
ngtggtgtctgagtacttn

SEQ ID NO: 791 - RNA, 19 nt, synthetic construct
  source 1..19: mol_type = other RNA
tgtggtgtctgagtacttn

SEQ ID NO: 792 - RNA, 19 nt, synthetic construct
  source 1..19: mol_type = other RNA
ngtggtgtctgagtactta

SEQ ID NO: 793 - RNA, 19 nt, synthetic construct
  source 1..19: mol_type = other RNA
ngtggtgtctgagtacttn

SEQ ID NO: 794 - RNA, 19 nt, synthetic construct
  source 1..19: mol_type = other RNA
tgtctgagtactttgtgct

SEQ ID NO: 795 - RNA, 19 nt, synthetic construct
  source 1..19: mol_type = other RNA
tgtctgagtactttgtgca

SEQ ID NO: 796 - RNA, 19 nt, synthetic construct
  source 1..19: mol_type = other RNA
tgtctgagtactttgtgcn

SEQ ID NO: 797 - RNA, 19 nt, synthetic construct
  source 1..19: mol_type = other RNA
ngtctgagtactttgtgct

SEQ ID NO: 798 - RNA, 19 nt, synthetic construct
  source 1..19: mol_type = other RNA
ngtctgagtactttgtgcn

SEQ ID NO: 799 - RNA, 19 nt, synthetic construct
  modified_base 17: mod_base = i
  source 1..19: mol_type = other RNA
tgtctgagtactttgtnct

SEQ ID NO: 800 - RNA, 19 nt, synthetic construct
  modified_base 17: mod_base = i
  source 1..19: mol_type = other RNA
tgtctgagtactttgtnca

SEQ ID NO: 801 - RNA, 19 nt, synthetic construct
  modified_base 17: mod_base = i
  source 1..19: mol_type = other RNA
tgtctgagtactttgtncn

SEQ ID NO: 802 - RNA, 19 nt, synthetic construct
  modified_base 17: mod_base = i
  source 1..19: mol_type = other RNA
ngtctgagtactttgtnct

SEQ ID NO: 803 - RNA, 19 nt, synthetic construct
  modified_base 17: mod_base = i
  source 1..19: mol_type = other RNA
ngtctgagtactttgtncn

SEQ ID NO: 804 - RNA, 19 nt, synthetic construct
  source 1..19: mol_type = other RNA
gtctgagtactttgtgctg

SEQ ID NO: 805 - RNA, 19 nt, synthetic construct
  source 1..19: mol_type = other RNA
gtctgagtactttgtgcta

SEQ ID NO: 806 - RNA, 19 nt, synthetic construct
  source 1..19: mol_type = other RNA
gtctgagtactttgtgctn

SEQ ID NO: 807 - RNA, 19 nt, synthetic construct
  source 1..19: mol_type = other RNA
ntctgagtactttgtgcta

SEQ ID NO: 808 - RNA, 19 nt, synthetic construct
  source 1..19: mol_type = other RNA
ntctgagtactttgtgctn

SEQ ID NO: 809 - RNA, 19 nt, synthetic construct
  modified_base 16: mod_base = i
  source 1..19: mol_type = other RNA
gtctgagtactttgtnctg

SEQ ID NO: 810 - RNA, 19 nt, synthetic construct
  modified_base 16: mod_base = i
  source 1..19: mol_type = other RNA
gtctgagtactttgtncta

SEQ ID NO: 811 - RNA, 19 nt, synthetic construct
  modified_base 16: mod_base = i
  source 1..19: mol_type = other RNA
gtctgagtactttgtnctn

SEQ ID NO: 812 - RNA, 19 nt, synthetic construct
  modified_base 16: mod_base = i
  source 1..19: mol_type = other RNA
ntctgagtactttgtncta

SEQ ID NO: 813 - RNA, 19 nt, synthetic construct
  modified_base 16: mod_base = i
  source 1..19: mol_type = other RNA
ntctgagtactttgtnctn

SEQ ID NO: 814 - RNA, 19 nt, synthetic construct
  source 1..19: mol_type = other RNA
tgacagcagcacattgttt

SEQ ID NO: 815 - RNA, 19 nt, synthetic construct
  source 1..19: mol_type = other RNA
tgacagcagcacattgtta

SEQ ID NO: 816 - RNA, 19 nt, synthetic construct
  source 1..19: mol_type = other RNA
tgacagcagcacattgttn

SEQ ID NO: 817 - RNA, 19 nt, synthetic construct
  source 1..19: mol_type = other RNA
ngacagcagcacattgttt

SEQ ID NO: 818 - RNA, 19 nt, synthetic construct
  source 1..19: mol_type = other RNA
ngacagcagcacattgttn

SEQ ID NO: 819 - RNA, 19 nt, synthetic construct
  source 1..19: mol_type = other RNA
gacgttgccctgatcaagc

SEQ ID NO: 820 - RNA, 19 nt, synthetic construct
  source 1..19: mol_type = other RNA
gacgttgccctgatcaaga

SEQ ID NO: 821 - RNA, 19 nt, synthetic construct
  source 1..19: mol_type = other RNA
gacgttgccctgatcaagn

SEQ ID NO: 822 - RNA, 19 nt, synthetic construct
  source 1..19: mol_type = other RNA
nacgttgccctgatcaaga

SEQ ID NO: 823 - RNA, 19 nt, synthetic construct
  source 1..19: mol_type = other RNA
nacgttgccctgatcaagn

SEQ ID NO: 824 - RNA, 19 nt, synthetic construct
  source 1..19: mol_type = other RNA
acgttgccctgatcaagct

SEQ ID NO: 825 - RNA, 19 nt, synthetic construct
  source 1..19: mol_type = other RNA
acgttgccctgatcaagca

SEQ ID NO: 826 - RNA, 19 nt, synthetic construct
  source 1..19: mol_type = other RNA
acgttgccctgatcaagcn

SEQ ID NO: 827 - RNA, 19 nt, synthetic construct
  source 1..19: mol_type = other RNA
ncgttgccctgatcaagct

SEQ ID NO: 828 - RNA, 19 nt, synthetic construct
  source 1..19: mol_type = other RNA
ncgttgccctgatcaagcn

SEQ ID NO: 829 - RNA, 19 nt, synthetic construct
  modified_base 17: mod_base = i
  source 1..19: mol_type = other RNA
acgttgccctgatcaanct

SEQ ID NO: 830 - RNA, 19 nt, synthetic construct
  modified_base 17: mod_base = i
  source 1..19: mol_type = other RNA
acgttgccctgatcaanca

SEQ ID NO: 831 - RNA, 19 nt, synthetic construct
  modified_base 17: mod_base = i
  source 1..19: mol_type = other RNA
acgttgccctgatcaancn

SEQ ID NO: 832 - RNA, 19 nt, synthetic construct
  modified_base 17: mod_base = i
  source 1..19: mol_type = other RNA
ncgttgccctgatcaanct

SEQ ID NO: 833 - RNA, 19 nt, synthetic construct
  modified_base 17: mod_base = i
  source 1..19: mol_type = other RNA
ncgttgccctgatcaancn

SEQ ID NO: 834 - RNA, 19 nt, synthetic construct
  source 1..19: mol_type = other RNA
tttcattcaagttggtgta

SEQ ID NO: 835 - RNA, 19 nt, synthetic construct
  source 1..19: mol_type = other RNA
tttcattcaagttggtgtn

SEQ ID NO: 836 - RNA, 19 nt, synthetic construct
  source 1..19: mol_type = other RNA
nttcattcaagttggtgta

SEQ ID NO: 837 - RNA, 19 nt, synthetic construct
  source 1..19: mol_type = other RNA
nttcattcaagttggtgtn

SEQ ID NO: 838 - RNA, 19 nt, synthetic construct
  modified_base 15: mod_base = i
  source 1..19: mol_type = other RNA
tttcattcaagttgntgta

SEQ ID NO: 839 - RNA, 19 nt, synthetic construct
  modified_base 15: mod_base = i
  source 1..19: mol_type = other RNA
tttcattcaagttgntgtn

SEQ ID NO: 840 - RNA, 19 nt, synthetic construct
  modified_base 15: mod_base = i
  source 1..19: mol_type = other RNA
nttcattcaagttgntgta

SEQ ID NO: 841 - RNA, 19 nt, synthetic construct
  modified_base 15: mod_base = i
  source 1..19: mol_type = other RNA
nttcattcaagttgntgtn

SEQ ID NO: 842 - RNA, 19 nt, synthetic construct
  source 1..19: mol_type = other RNA
aatcagctggggagtagtg

SEQ ID NO: 843 - RNA, 19 nt, synthetic construct
  source 1..19: mol_type = other RNA
aatcagctggggagtagta

SEQ ID NO: 844 - RNA, 19 nt, synthetic construct
  source 1..19: mol_type = other RNA
aatcagctggggagtagtn

SEQ ID NO: 845 - RNA, 19 nt, synthetic construct
  source 1..19: mol_type = other RNA
natcagctggggagtagta

SEQ ID NO: 846 - RNA, 19 nt, synthetic construct
  source 1..19: mol_type = other RNA
natcagctggggagtagtn

SEQ ID NO: 847 - RNA, 19 nt, synthetic construct
  modified_base 1: mod_base = OTHER; note = 2'-O-methyl-2-aminoadenosine
  source 1..19: mol_type = other RNA
natcagctggggagtagtg

SEQ ID NO: 848 - RNA, 19 nt, synthetic construct
  modified_base 1: mod_base = OTHER; note = 2'-O-methyl-2-aminoadenosine
  source 1..19: mol_type = other RNA
natcagctggggagtagta

SEQ ID NO: 849 - RNA, 19 nt, synthetic construct
  modified_base 1: mod_base = OTHER; note = 2'-O-methyl-2-aminoadenosine
  source 1..19: mol_type = other RNA
natcagctggggagtagtn

SEQ ID NO: 850 - RNA, 19 nt, synthetic construct
  source 1..19: mol_type = other RNA
tcagctggggagtagtgga

SEQ ID NO: 851 - RNA, 19 nt, synthetic construct
  source 1..19: mol_type = other RNA
tcagctggggagtagtggn

SEQ ID NO: 852 - RNA, 19 nt, synthetic construct
  source 1..19: mol_type = other RNA
ncagctggggagtagtgga

SEQ ID NO: 853 - RNA, 19 nt, synthetic construct
  source 1..19: mol_type = other RNA
ncagctggggagtagtggn

SEQ ID NO: 854 - RNA, 19 nt, synthetic construct
  modified_base 17: mod_base = i
  source 1..19: mol_type = other RNA
tcagctggggagtagtnga

SEQ ID NO: 855 - RNA, 19 nt, synthetic construct
  modified_base 17: mod_base = i
  source 1..19: mol_type = other RNA
tcagctggggagtagtngn

SEQ ID NO: 856 - RNA, 19 nt, synthetic construct
  modified_base 17: mod_base = i
  source 1..19: mol_type = other RNA
ncagctggggagtagtnga

SEQ ID NO: 857 - RNA, 19 nt, synthetic construct
  modified_base 17: mod_base = i
  source 1..19: mol_type = other RNA
ncagctggggagtagtngn

SEQ ID NO: 858 - RNA, 19 nt, synthetic construct
  source 1..19: mol_type = other RNA
ctggggagtagtggatgtc

SEQ ID NO: 859 - RNA, 19 nt, synthetic construct
  source 1..19: mol_type = other RNA
ctggggagtagtggatgta

SEQ ID NO: 860 - RNA, 19 nt, synthetic construct
  source 1..19: mol_type = other RNA
ctggggagtagtggatgtn

SEQ ID NO: 861 - RNA, 19 nt, synthetic construct
  source 1..19: mol_type = other RNA
ntggggagtagtggatgta

SEQ ID NO: 862 - RNA, 19 nt, synthetic construct
  source 1..19: mol_type = other RNA
ntggggagtagtggatgtn

SEQ ID NO: 863 - RNA, 19 nt, synthetic construct
  modified_base 14: mod_base = i
  source 1..19: mol_type = other RNA
ctggggagtagtgnatgtc

SEQ ID NO: 864 - RNA, 19 nt, synthetic construct
  modified_base 14: mod_base = i
  source 1..19: mol_type = other RNA
ctggggagtagtgnatgta

SEQ ID NO: 865 - RNA, 19 nt, synthetic construct
  modified_base 14: mod_base = i
  source 1..19: mol_type = other RNA
ctggggagtagtgnatgtn

SEQ ID NO: 866 - RNA, 19 nt, synthetic construct
  modified_base 14: mod_base = i
  source 1..19: mol_type = other RNA
ntggggagtagtgnatgta

SEQ ID NO: 867 - RNA, 19 nt, synthetic construct
  modified_base 14: mod_base = i
  source 1..19: mol_type = other RNA
ntggggagtagtgnatgtn

SEQ ID NO: 868 - RNA, 19 nt, synthetic construct
  source 1..19: mol_type = other RNA
ggggagtagtggatgtctg

SEQ ID NO: 869 - RNA, 19 nt, synthetic construct
  source 1..19: mol_type = other RNA
ggggagtagtggatgtcta

SEQ ID NO: 870 - RNA, 19 nt, synthetic construct
  source 1..19: mol_type = other RNA
ggggagtagtggatgtctn

SEQ ID NO: 871 - RNA, 19 nt, synthetic construct
  source 1..19: mol_type = other RNA
ngggagtagtggatgtcta

SEQ ID NO: 872 - RNA, 19 nt, synthetic construct
  source 1..19: mol_type = other RNA
ngggagtagtggatgtctn

SEQ ID NO: 873 - RNA, 19 nt, synthetic construct
  source 1..19: mol_type = other RNA
caagatgaggatttgggtt

SEQ ID NO: 874 - RNA, 19 nt, synthetic construct
  source 1..19: mol_type = other RNA
caagatgaggatttgggta

SEQ ID NO: 875 - RNA, 19 nt, synthetic construct
  source 1..19: mol_type = other RNA
caagatgaggatttgggtn

SEQ ID NO: 876 - RNA, 19 nt, synthetic construct
  source 1..19: mol_type = other RNA
naagatgaggatttgggtt

SEQ ID NO: 877 - RNA, 19 nt, synthetic construct
  source 1..19: mol_type = other RNA
naagatgaggatttgggtn

SEQ ID NO: 878 - RNA, 19 nt, synthetic construct
  modified_base 16: mod_base = i
  source 1..19: mol_type = other RNA
caagatgaggatttgngtt

SEQ ID NO: 879 - RNA, 19 nt, synthetic construct
  modified_base 16: mod_base = i
  source 1..19: mol_type = other RNA
caagatgaggatttgngta

SEQ ID NO: 880 - RNA, 19 nt, synthetic construct
  modified_base 16: mod_base = i
  source 1..19: mol_type = other RNA
caagatgaggatttgngtn

SEQ ID NO: 881 - RNA, 19 nt, synthetic construct
  modified_base 16: mod_base = i
  source 1..19: mol_type = other RNA
naagatgaggatttgngtt

SEQ ID NO: 882 - RNA, 19 nt, synthetic construct
  modified_base 16: mod_base = i
  source 1..19: mol_type = other RNA
naagatgaggatttgngtn

SEQ ID NO: 883 - RNA, 19 nt, synthetic construct
  source 1..19: mol_type = other RNA
aagatgaggatttgggttt

SEQ ID NO: 884 - RNA, 19 nt, synthetic construct
  source 1..19: mol_type = other RNA
aagatgaggatttgggtta

SEQ ID NO: 885 - RNA, 19 nt, synthetic construct
  source 1..19: mol_type = other RNA
aagatgaggatttgggttn

SEQ ID NO: 886 - RNA, 19 nt, synthetic construct
  source 1..19: mol_type = other RNA
nagatgaggatttgggttt

SEQ ID NO: 887 - RNA, 19 nt, synthetic construct
  source 1..19: mol_type = other RNA
nagatgaggatttgggttn

SEQ ID NO: 888 - RNA, 19 nt, synthetic construct
  modified_base 15: mod_base = i
  source 1..19: mol_type = other RNA
aagatgaggatttgngttt

SEQ ID NO: 889 - RNA, 19 nt, synthetic construct
  modified_base 15: mod_base = i
  source 1..19: mol_type = other RNA
aagatgaggatttgngtta

SEQ ID NO: 890 - RNA, 19 nt, synthetic construct
  modified_base 15: mod_base = i
  source 1..19: mol_type = other RNA
aagatgaggatttgngttn

SEQ ID NO: 891 - RNA, 19 nt, synthetic construct
  modified_base 15: mod_base = i
  source 1..19: mol_type = other RNA
nagatgaggatttgngttt

SEQ ID NO: 892 - RNA, 19 nt, synthetic construct
  modified_base 15: mod_base = i
  source 1..19: mol_type = other RNA
nagatgaggatttgngttn

SEQ ID NO: 893 - RNA, 19 nt, synthetic construct
  source 1..19: mol_type = other RNA
tgaggatttgggttttcta

SEQ ID NO: 894 - RNA, 19 nt, synthetic construct
  source 1..19: mol_type = other RNA
tgaggatttgggttttctn

SEQ ID NO: 895 - RNA, 19 nt, synthetic construct
  source 1..19: mol_type = other RNA
ngaggatttgggttttcta

SEQ ID NO: 896 - RNA, 19 nt, synthetic construct
  source 1..19: mol_type = other RNA
ngaggatttgggttttctn

SEQ ID NO: 897 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = um
  modified_base 3^4: mod_base = OTHER; note = phosphorothioate linkage
  modified_base 4: mod_base = OTHER; note = 2'-fluorocytidine
  modified_base 5: mod_base = um
  modified_base 6: mod_base = OTHER; note = 2'-fluoroadenosine
  modified_base 7: mod_base = gm
  modified_base 8: mod_base = OTHER; note = 2'-fluorocytidine
  modified_base 9: mod_base = OTHER; note = 2'-O-methyladenosine
  modified_base 10: mod_base = OTHER; note = 2'-fluorocytidine
  modified_base 11: mod_base = cm
  modified_base 12: mod_base = OTHER; note = 2'-fluoroadenosine
  modified_base 13: mod_base = gm
  modified_base 14: mod_base = OTHER; note = 2'-fluoroguanosine
  modified_base 15: mod_base = um
  modified_base 16: mod_base = OTHER; note = 2'-fluoroadenosine
  modified_base 17: mod_base = gm
  modified_base 18: mod_base = OTHER; note = 2'-fluoroadenosine
  modified_base 19: mod_base = um
  modified_base 20: mod_base = OTHER; note = 2'-fluoroguanosine
  modified_base 20^21: mod_base = OTHER; note = phosphorothioate linkage
  modified_base 21: mod_base = cm
  source 1..21: mol_type = other RNA
tatctagcaccaggtagatgc

SEQ ID NO: 898 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluorouridine
  modified_base 5: mod_base = cm
  modified_base 6: mod_base = OTHER; note = 2'-fluorouridine
  modified_base 7: mod_base = OTHER; note = 2'-O-methyladenosine
  modified_base 8: mod_base = OTHER; note = 2'-fluoroguanosine
  modified_base 9: mod_base = cm
  modified_base 10: mod_base = OTHER; note = 2'-fluoroadenosine
  modified_base 11: mod_base = cm
  modified_base 12: mod_base = OTHER; note = 2'-fluorocytidine
  modified_base 13: mod_base = OTHER; note = 2'-O-methyladenosine
  modified_base 14: mod_base = OTHER; note = 2'-fluoroguanosine
  modified_base 15: mod_base = gm
  modified_base 16: mod_base = OTHER; note = 2'-fluorouridine
  modified_base 17: mod_base = OTHER; note = 2'-O-methyladenosine
  modified_base 18: mod_base = OTHER; note = 2'-fluoroguanosine
  modified_base 19: mod_base = OTHER; note = 2'-O-methyladenosine
  modified_base 20: mod_base = OTHER; note = 2'-fluorouridine
  modified_base 20^21: mod_base = OTHER; note = phosphorothioate linkage
  modified_base 21: mod_base = gm
  source 1..21: mol_type = other RNA
tcatctagcaccaggtagatg

SEQ ID NO: 899 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluoroadenosine
  modified_base 5: mod_base = um
  modified_base 6: mod_base = OTHER; note = 2'-fluorocytidine
  modified_base 7: mod_base = um
  modified_base 8: mod_base = OTHER; note = 2'-fluoroadenosine
  modified_base 9: mod_base = gm
  modified_base 10: mod_base = OTHER; note = 2'-fluorocytidine
  modified_base 11: mod_base = OTHER; note = 2'-O-methyladenosine
  modified_base 12: mod_base = OTHER; note = 2'-fluorocytidine
  modified_base 13: mod_base = cm
  modified_base 14: mod_base = OTHER; note = 2'-fluoroadenosine
  modified_base 15: mod_base = gm
  modified_base 16: mod_base = OTHER; note = 2'-fluoroguanosine
  modified_base 17: mod_base = um
  modified_base 18: mod_base = OTHER; note = 2'-fluoroadenosine
  modified_base 19: mod_base = gm
  modified_base 20: mod_base = OTHER; note = 2'-fluoroadenosine
  modified_base 20^21: mod_base = OTHER; note = phosphorothioate linkage
  modified_base 21: mod_base = um
  source 1..21: mol_type = other RNA
tccatctagcaccaggtagat

SEQ ID NO: 900 - DNA, 21 bp, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluorocytidine
  modified_base 5: mod_base = OTHER; note = 2'-O-methyladenosine
  modified_base 6: mod_base = OTHER; note = 2'-fluorouridine
  modified_base 7: mod_base = cm
  modified_base 8: mod_base = OTHER; note = 2'-fluorouridine
  modified_base 9: mod_base = OTHER; note = 2'-O-methyladenosine
  modified_base 10: mod_base = OTHER; note = 2'-fluoroguanosine
  modified_base 11: mod_base = cm
  modified_base 12: mod_base = OTHER; note = 2'-fluoroadenosine
  modified_base 13: mod_base = cm
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluoroguanosine
  modified_base 17: mod_base = gm
  modified_base 18: mod_base = OTHER; note = 2'-fluorouridine
  modified_base 19: mod_base = OTHER; note = 2'-O-methyladenosine
  modified_base 20: mod_base = OTHER; note = 2'-fluoroguanosine
  modified_base 20^21: mod_base = OTHER; note = phosphorothioate linkage
  modified_base 21: mod_base = OTHER; note = 2'-O-methyladenosine
  source 1..21: mol_type = other DNA
atccatctagcaccaggtaga

SEQ ID NO: 901 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluorouridine
  modified_base 5: mod_base = cm
  modified_base 6: mod_base = OTHER; note = 2'-fluorocytidine
  modified_base 7: mod_base = OTHER; note = 2'-O-methyladenosine
  modified_base 8: mod_base = OTHER; note = 2'-fluorouridine
  modified_base 9: mod_base = cm
  modified_base 10: mod_base = OTHER; note = 2'-fluorouridine
  modified_base 11: mod_base = OTHER; note = 2'-O-methyladenosine
  modified_base 12: mod_base = OTHER; note = 2'-fluoroguanosine
  modified_base 13: mod_base = cm
  modified_base 14: mod_base = OTHER; note = 2'-fluoroadenosine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = OTHER; note = 2'-fluoroguanosine
  modified_base 19: mod_base = gm
  modified_base 20: mod_base = OTHER; note = 2'-fluorouridine
  modified_base 20^21: mod_base = OTHER; note = phosphorothioate linkage
  modified_base 21: mod_base = OTHER; note = 2'-O-methyladenosine
  source 1..21: mol_type = other RNA
tgatccatctagcaccaggta

SEQ ID NO: 902 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = um
  modified_base 3^4: mod_base = OTHER; note = phosphorothioate linkage
  modified_base 4: mod_base = OTHER; note = 2'-fluorocytidine
  modified_base 5: mod_base = um
  modified_base 6: mod_base = OTHER; note = 2'-fluoroguanosine
  modified_base 7: mod_base = OTHER; note = 2'-O-methyladenosine
  modified_base 8: mod_base = OTHER; note = 2'-fluorouridine
  modified_base 9: mod_base = cm
  modified_base 10: mod_base = OTHER; note = 2'-fluorocytidine
  modified_base 11: mod_base = OTHER; note = 2'-O-methyladenosine
  modified_base 12: mod_base = OTHER; note = 2'-fluorouridine
  modified_base 13: mod_base = cm
  modified_base 14: mod_base = OTHER; note = 2'-fluorouridine
  modified_base 15: mod_base = OTHER; note = 2'-O-methyladenosine
  modified_base 16: mod_base = OTHER; note = 2'-fluoroguanosine
  modified_base 17: mod_base = cm
  modified_base 18: mod_base = OTHER; note = 2'-fluoroadenosine
  modified_base 19: mod_base = cm
  modified_base 20: mod_base = OTHER; note = 2'-fluorocytidine
  modified_base 20^21: mod_base = OTHER; note = phosphorothioate linkage
  modified_base 21: mod_base = OTHER; note = 2'-O-methyladenosine
  source 1..21: mol_type = other RNA
tgtctgatccatctagcacca

SEQ ID NO: 903 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-fluorocytidine
  modified_base 5: mod_base = um
  modified_base 6: mod_base = OTHER; note = 2'-fluoroguanosine
  modified_base 7: mod_base = um
  modified_base 8: mod_base = OTHER; note = 2'-fluorocytidine
  modified_base 9: mod_base = um
  modified_base 10: mod_base = OTHER; note = 2'-fluoroguanosine
  modified_base 11: mod_base = OTHER; note = 2'-O-methyladenosine
  modified_base 12: mod_base = OTHER; note = 2'-fluorouridine
  modified_base 13: mod_base = cm
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluorouridine
  modified_base 17: mod_base = cm
  modified_base 18: mod_base = OTHER; note = 2'-fluorouridine
  modified_base 19: mod_base = OTHER; note = 2'-O-methyladenosine
  modified_base 20: mod_base = OTHER; note = 2'-fluoroguanosine
  modified_base 20^21: mod_base = OTHER; note = phosphorothioate linkage
  modified_base 21: mod_base = cm
  source 1..21: mol_type = other RNA
atgctgtctgatccatctagc

SEQ ID NO: 904 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = um
  modified_base 3^4: mod_base = OTHER; note = phosphorothioate linkage
  modified_base 4: mod_base = OTHER; note = 2'-fluoroguanosine
  modified_base 5: mod_base = cm
  modified_base 6: mod_base = OTHER; note = 2'-fluorocytidine
  modified_base 7: mod_base = OTHER; note = 2'-O-methyladenosine
  modified_base 8: mod_base = OTHER; note = 2'-fluorocytidine
  modified_base 9: mod_base = OTHER; note = 2'-O-methyladenosine
  modified_base 10: mod_base = OTHER; note = 2'-fluoroguanosine
  modified_base 11: mod_base = OTHER; note = 2'-O-methyladenosine
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-fluorocytidine
  modified_base 15: mod_base = um
  modified_base 16: mod_base = OTHER; note = 2'-fluorocytidine
  modified_base 17: mod_base = OTHER; note = 2'-O-methyladenosine
  modified_base 18: mod_base = OTHER; note = 2'-fluoroguanosine
  modified_base 19: mod_base = OTHER; note = 2'-O-methyladenosine
  modified_base 20: mod_base = OTHER; note = 2'-fluoroguanosine
  modified_base 20^21: mod_base = OTHER; note = phosphorothioate linkage
  modified_base 21: mod_base = OTHER; note = 2'-O-methyladenosine
  source 1..21: mol_type = other RNA
tatgccacagagactcagaga

SEQ ID NO: 905 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluoroguanosine
  modified_base 5: mod_base = um
  modified_base 6: mod_base = OTHER; note = 2'-fluoroadenosine
  modified_base 7: mod_base = cm
  modified_base 8: mod_base = OTHER; note = 2'-fluorouridine
  modified_base 9: mod_base = cm
  modified_base 10: mod_base = OTHER; note = 2'-fluoroadenosine
  modified_base 11: mod_base = gm
  modified_base 12: mod_base = OTHER; note = 2'-fluoroadenosine
  modified_base 13: mod_base = cm
  modified_base 14: mod_base = OTHER; note = 2'-fluoroadenosine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = OTHER; note = 2'-fluorocytidine
  modified_base 19: mod_base = OTHER; note = 2'-O-methyladenosine
  modified_base 20: mod_base = OTHER; note = 2'-fluoroguanosine
  modified_base 20^21: mod_base = OTHER; note = phosphorothioate linkage
  modified_base 21: mod_base = cm
  source 1..21: mol_type = other RNA
aaagtactcagacaccacagc

SEQ ID NO: 906 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluoroadenosine
  modified_base 5: mod_base = cm
  modified_base 6: mod_base = OTHER; note = 2'-fluorocytidine
  modified_base 7: mod_base = OTHER; note = 2'-O-methyladenosine
  modified_base 8: mod_base = OTHER; note = 2'-fluoroadenosine
  modified_base 9: mod_base = cm
  modified_base 10: mod_base = OTHER; note = 2'-fluorouridine
  modified_base 11: mod_base = um
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-fluoroadenosine
  modified_base 15: mod_base = um
  modified_base 16: mod_base = OTHER; note = 2'-fluoroguanosine
  modified_base 17: mod_base = OTHER; note = 2'-O-methyladenosine
  modified_base 18: mod_base = OTHER; note = 2'-fluoroadenosine
  modified_base 19: mod_base = OTHER; note = 2'-O-methyladenosine
  modified_base 20: mod_base = OTHER; note = 2'-fluorocytidine
  modified_base 20^21: mod_base = OTHER; note = phosphorothioate linkage
  modified_base 21: mod_base = gm
  source 1..21: mol_type = other RNA
tacaccaacttgaatgaaacg

SEQ ID NO: 907 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluorouridine
  modified_base 5: mod_base = OTHER; note = 2'-O-methyladenosine
  modified_base 6: mod_base = OTHER; note = 2'-fluorocytidine
  modified_base 7: mod_base = um
  modified_base 8: mod_base = OTHER; note = 2'-fluorocytidine
  modified_base 9: mod_base = cm
  modified_base 10: mod_base = OTHER; note = 2'-fluorocytidine
  modified_base 11: mod_base = cm
  modified_base 12: mod_base = OTHER; note = 2'-fluoroadenosine
  modified_base 13: mod_base = gm
  modified_base 14: mod_base = OTHER; note = 2'-fluorocytidine
  modified_base 15: mod_base = um
  modified_base 16: mod_base = OTHER; note = 2'-fluoroguanosine
  modified_base 17: mod_base = OTHER; note = 2'-O-methyladenosine
  modified_base 18: mod_base = OTHER; note = 2'-fluorouridine
  modified_base 19: mod_base = um
  modified_base 20: mod_base = OTHER; note = 2'-fluoroadenosine
  modified_base 20^21: mod_base = OTHER; note = phosphorothioate linkage
  modified_base 21: mod_base = cm
  source 1..21: mol_type = other RNA
tactactccccagctgattac

SEQ ID NO: 908 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluoroadenosine
  modified_base 5: mod_base = cm
  modified_base 6: mod_base = OTHER; note = 2'-fluorouridine
  modified_base 7: mod_base = OTHER; note = 2'-O-methyladenosine
  modified_base 8: mod_base = OTHER; note = 2'-fluorocytidine
  modified_base 9: mod_base = um
  modified_base 10: mod_base = OTHER; note = 2'-fluorocytidine
  modified_base 11: mod_base = cm
  modified_base 12: mod_base = OTHER; note = 2'-fluorocytidine
  modified_base 13: mod_base = cm
  modified_base 14: mod_base = OTHER; note = 2'-fluoroadenosine
  modified_base 15: mod_base = gm
  modified_base 16: mod_base = OTHER; note = 2'-fluorocytidine
  modified_base 17: mod_base = um
  modified_base 18: mod_base = OTHER; note = 2'-fluoroguanosine
  modified_base 19: mod_base = OTHER; note = 2'-O-methyladenosine
  modified_base 20: mod_base = OTHER; note = 2'-fluorouridine
  modified_base 20^21: mod_base = OTHER; note = phosphorothioate linkage
  modified_base 21: mod_base = cm
  source 1..21: mol_type = other RNA
tccactactccccagctgatc

SEQ ID NO: 909 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluoroadenosine
  modified_base 5: mod_base = um
  modified_base 6: mod_base = OTHER; note = 2'-fluorocytidine
  modified_base 7: mod_base = cm
  modified_base 8: mod_base = OTHER; note = 2'-fluoroadenosine
  modified_base 9: mod_base = cm
  modified_base 10: mod_base = OTHER; note = 2'-fluorouridine
  modified_base 11: mod_base = OTHER; note = 2'-O-methyladenosine
  modified_base 12: mod_base = OTHER; note = 2'-fluorocytidine
  modified_base 13: mod_base = um
  modified_base 14: mod_base = OTHER; note = 2'-fluorocytidine
  modified_base 15: mod_base = cm
  modified_base 16: mod_base = OTHER; note = 2'-fluorocytidine
  modified_base 17: mod_base = cm
  modified_base 18: mod_base = OTHER; note = 2'-fluoroadenosine
  modified_base 19: mod_base = gm
  modified_base 20: mod_base = OTHER; note = 2'-fluorocytidine
  modified_base 20^21: mod_base = OTHER; note = phosphorothioate linkage
  modified_base 21: mod_base = um
  source 1..21: mol_type = other RNA
tacatccactactccccagct

SEQ ID NO: 910 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-fluoroadenosine
  modified_base 5: mod_base = cm
  modified_base 6: mod_base = OTHER; note = 2'-fluoroadenosine
  modified_base 7: mod_base = um
  modified_base 8: mod_base = OTHER; note = 2'-fluorocytidine
  modified_base 9: mod_base = cm
  modified_base 10: mod_base = OTHER; note = 2'-fluoroadenosine
  modified_base 11: mod_base = cm
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluorocytidine
  modified_base 15: mod_base = um
  modified_base 16: mod_base = OTHER; note = 2'-fluorocytidine
  modified_base 17: mod_base = cm
  modified_base 18: mod_base = OTHER; note = 2'-fluorocytidine
  modified_base 19: mod_base = cm
  modified_base 20: mod_base = OTHER; note = 2'-fluoroadenosine
  modified_base 20^21: mod_base = OTHER; note = phosphorothioate linkage
  modified_base 21: mod_base = gm
  source 1..21: mol_type = other RNA
tagacatccactactccccag

SEQ ID NO: 911 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluorocytidine
  modified_base 5: mod_base = cm
  modified_base 6: mod_base = OTHER; note = 2'-fluoroadenosine
  modified_base 7: mod_base = OTHER; note = 2'-O-methyladenosine
  modified_base 8: mod_base = OTHER; note = 2'-fluoroadenosine
  modified_base 9: mod_base = um
  modified_base 10: mod_base = OTHER; note = 2'-fluorocytidine
  modified_base 11: mod_base = cm
  modified_base 12: mod_base = OTHER; note = 2'-fluorouridine
  modified_base 13: mod_base = cm
  modified_base 14: mod_base = OTHER; note = 2'-fluoroadenosine
  modified_base 15: mod_base = um
  modified_base 16: mod_base = OTHER; note = 2'-fluorocytidine
  modified_base 17: mod_base = um
  modified_base 18: mod_base = OTHER; note = 2'-fluorouridine
  modified_base 19: mod_base = gm
  modified_base 20: mod_base = OTHER; note = 2'-fluoroguanosine
  modified_base 20^21: mod_base = OTHER; note = phosphorothioate linkage
  modified_base 21: mod_base = OTHER; note = 2'-O-methyladenosine
  source 1..21: mol_type = other RNA
aacccaaatcctcatcttgga

SEQ ID NO: 912 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluorocytidine
  modified_base 5: mod_base = cm
  modified_base 6: mod_base = OTHER; note = 2'-fluorocytidine
  modified_base 7: mod_base = OTHER; note = 2'-O-methyladenosine
  modified_base 8: mod_base = OTHER; note = 2'-fluoroadenosine
  modified_base 9: mod_base = OTHER; note = 2'-O-methyladenosine
  modified_base 10: mod_base = OTHER; note = 2'-fluorouridine
  modified_base 11: mod_base = cm
  modified_base 12: mod_base = OTHER; note = 2'-fluorocytidine
  modified_base 13: mod_base = um
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluorouridine
  modified_base 17: mod_base = cm
  modified_base 18: mod_base = OTHER; note = 2'-fluorouridine
  modified_base 19: mod_base = um
  modified_base 20: mod_base = OTHER; note = 2'-fluoroguanosine
  modified_base 20^21: mod_base = OTHER; note = phosphorothioate linkage
  modified_base 21: mod_base = gm
  source 1..21: mol_type = other RNA
aaacccaaatcctcatcttgg

SEQ ID NO: 913 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-fluoroadenosine
  modified_base 5: mod_base = OTHER; note = 2'-O-methyladenosine
  modified_base 6: mod_base = OTHER; note = 2'-fluoroadenosine
  modified_base 7: mod_base = OTHER; note = 2'-O-methyladenosine
  modified_base 8: mod_base = OTHER; note = 2'-fluorocytidine
  modified_base 9: mod_base = cm
  modified_base 10: mod_base = OTHER; note = 2'-fluorocytidine
  modified_base 11: mod_base = OTHER; note = 2'-O-methyladenosine
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluorocytidine
  modified_base 17: mod_base = um
  modified_base 18: mod_base = OTHER; note = 2'-fluorocytidine
  modified_base 19: mod_base = OTHER; note = 2'-O-methyladenosine
  modified_base 20: mod_base = OTHER; note = 2'-fluorouridine
  modified_base 20^21: mod_base = OTHER; note = phosphorothioate linkage
  modified_base 21: mod_base = cm
  source 1..21: mol_type = other RNA
tagaaaacccaaatcctcatc

SEQ ID NO: 914 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-fluoroadenosine
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = cm
  modified_base 9: mod_base = cm
  modified_base 10: mod_base = cm
  modified_base 11: mod_base = OTHER; note = 2'-O-methyladenosine
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluorocytidine
  modified_base 17: mod_base = um
  modified_base 18: mod_base = cm
  modified_base 19: mod_base = OTHER; note = 2'-O-methyladenosine
  modified_base 20: mod_base = um
  modified_base 20^21: mod_base = OTHER; note = phosphorothioate linkage
  modified_base 21: mod_base = cm
  source 1..21: mol_type = other RNA
tagaaaacccaaatcctcatc

SEQ ID NO: 915 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-O-methyladenosine
  modified_base 5: mod_base = OTHER; note = 2'-fluoroadenosine
  modified_base 6: mod_base = OTHER; note = 2'-O-methyladenosine
  modified_base 7: mod_base = OTHER; note = 2'-O-methyladenosine
  modified_base 8: mod_base = cm
  modified_base 9: mod_base = cm
  modified_base 10: mod_base = cm
  modified_base 11: mod_base = OTHER; note = 2'-O-methyladenosine
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluorocytidine
  modified_base 17: mod_base = um
  modified_base 18: mod_base = cm
  modified_base 19: mod_base = OTHER; note = 2'-O-methyladenosine
  modified_base 20: mod_base = um
  modified_base 20^21: mod_base = OTHER; note = phosphorothioate linkage
  modified_base 21: mod_base = cm
  source 1..21: mol_type = other RNA
tagaaaacccaaatcctcatc

SEQ ID NO: 916 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-O-methyladenosine
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-fluoroadenosine
  modified_base 8: mod_base = cm
  modified_base 9: mod_base = cm
  modified_base 10: mod_base = cm
  modified_base 11: mod_base = OTHER; note = 2'-O-methyladenosine
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluorocytidine
  modified_base 17: mod_base = um
  modified_base 18: mod_base = cm
  modified_base 19: mod_base = OTHER; note = 2'-O-methyladenosine
  modified_base 20: mod_base = um
  modified_base 20^21: mod_base = OTHER; note = phosphorothioate linkage
  modified_base 21: mod_base = cm
  source 1..21: mol_type = other RNA
tagaaaacccaaatcctcatc

SEQ ID NO: 917 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-O-methyladenosine
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = cm
  modified_base 9: mod_base = OTHER; note = 2'-fluorocytidine
  modified_base 10: mod_base = cm
  modified_base 11: mod_base = OTHER; note = 2'-O-methyladenosine
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluorocytidine
  modified_base 17: mod_base = um
  modified_base 18: mod_base = cm
  modified_base 19: mod_base = OTHER; note = 2'-O-methyladenosine
  modified_base 20: mod_base = um
  modified_base 20^21: mod_base = OTHER; note = phosphorothioate linkage
  modified_base 21: mod_base = cm
  source 1..21: mol_type = other RNA
tagaaaacccaaatcctcatc

SEQ ID NO: 918 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-fluoroadenosine
  modified_base 5: mod_base = OTHER; note = 2'-O-methyladenosine
  modified_base 6: mod_base = OTHER; note = 2'-fluoroadenosine
  modified_base 7: mod_base = OTHER; note = 2'-O-methyladenosine
  modified_base 8: mod_base = cm
  modified_base 9: mod_base = cm
  modified_base 10: mod_base = cm
  modified_base 11: mod_base = OTHER; note = 2'-O-methyladenosine
  modified_base 12: mod_base = OTHER; note = 2'-O-methyladenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluorocytidine
  modified_base 17: mod_base = um
  modified_base 18: mod_base = cm
  modified_base 19: mod_base = OTHER; note = 2'-O-methyladenosine
  modified_base 20: mod_base = um
  modified_base 20^21: mod_base = OTHER; note = phosphorothioate linkage
  modified_base 21: mod_base = cm
  source 1..21: mol_type = other RNA
tagaaaacccaaatcctcatc

SEQ ID NO: 919 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-O-methyladenosine
  modified_base 5: mod_base = OTHER; note = 2'-O-methyladenosine
  modified_base 6: mod_base = OTHER; note = 2'-fluoroadenosine
  modified_base 7: mod_base = OTHER; note = 2'-O-methyladenosine
  modified_base 8: mod_base = cm
  modified_base 9: mod_base = cm
  modified_base 10: mod_base = cm
  modified_base 11: mod_base = OTHER; note = 2'-O-methyladenosine
  modified_base 12: mod_base = OTHER; note = 2'-O-methyladenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluorocytidine
  modified_base 17: mod_base = um
  modified_base 18: mod_base = cm
  modified_base 19: mod_base = OTHER; note = 2'-O-methyladenosine
  modified_base 20: mod_base = um
  modified_base 20^21: mod_base = OTHER; note = phosphorothioate linkage
  modified_base 21: mod_base = cm
  source 1..21: mol_type = other RNA
tagaaaacccaaatcctcatc

SEQ ID NO: 920 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-O-methyladenosine
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = cm
  modified_base 9: mod_base = cm
  modified_base 10: mod_base = cm
  modified_base 11: mod_base = OTHER; note = 2'-O-methyladenosine
  modified_base 12: mod_base = OTHER; note = 2'-O-methyladenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluorocytidine
  modified_base 17: mod_base = um
  modified_base 18: mod_base = cm
  modified_base 19: mod_base = OTHER; note = 2'-O-methyladenosine
  modified_base 20: mod_base = um
  modified_base 20^21: mod_base = OTHER; note = phosphorothioate linkage
  modified_base 21: mod_base = cm
  source 1..21: mol_type = other RNA
tagaaaacccaaatcctcatc

SEQ ID NO: 921 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-O-methyladenosine
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = cm
  modified_base 9: mod_base = cm
  modified_base 10: mod_base = cm
  modified_base 11: mod_base = OTHER; note = 2'-O-methyladenosine
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = cm
  modified_base 17: mod_base = um
  modified_base 18: mod_base = cm
  modified_base 19: mod_base = OTHER; note = 2'-O-methyladenosine
  modified_base 20: mod_base = um
  modified_base 20^21: mod_base = OTHER; note = phosphorothioate linkage
  modified_base 21: mod_base = cm
  source 1..21: mol_type = other RNA
tagaaaacccaaatcctcatc

SEQ ID NO: 922 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-O-methyladenosine
  modified_base 5: mod_base = OTHER; note = 2'-fluoroadenosine
  modified_base 6: mod_base = OTHER; note = 2'-O-methyladenosine
  modified_base 7: mod_base = OTHER; note = 2'-O-methyladenosine
  modified_base 8: mod_base = cm
  modified_base 9: mod_base = cm
  modified_base 10: mod_base = cm
  modified_base 11: mod_base = OTHER; note = 2'-O-methyladenosine
  modified_base 12: mod_base = OTHER; note = 2'-O-methyladenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = cm
  modified_base 17: mod_base = um
  modified_base 18: mod_base = cm
  modified_base 19: mod_base = OTHER; note = 2'-O-methyladenosine
  modified_base 20: mod_base = um
  modified_base 20^21: mod_base = OTHER; note = phosphorothioate linkage
  modified_base 21: mod_base = cm
  source 1..21: mol_type = other RNA
tagaaaacccaaatcctcatc

SEQ ID NO: 923 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 4: mod_base = OTHER; note = 2'-fluoroadenosine
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = cm
  modified_base 9: mod_base = cm
  modified_base 10: mod_base = cm
  modified_base 11: mod_base = OTHER; note = 2'-O-methyladenosine
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluorocytidine
  modified_base 17: mod_base = um
  modified_base 18: mod_base = cm
  modified_base 19: mod_base = OTHER; note = 2'-O-methyladenosine
  modified_base 20: mod_base = um
  modified_base 20^21: mod_base = OTHER; note = phosphorothioate linkage
  modified_base 21: mod_base = cm
  source 1..21: mol_type = other RNA
tagaaaacccaaatcctcatc

SEQ ID NO: 924 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-fluoroadenosine
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = cm
  modified_base 9: mod_base = cm
  modified_base 10: mod_base = cm
  modified_base 11: mod_base = OTHER; note = 2'-O-methyladenosine
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluorocytidine
  modified_base 17: mod_base = um
  modified_base 18: mod_base = cm
  modified_base 19: mod_base = OTHER; note = 2'-O-methyladenosine
  modified_base 20: mod_base = um
  modified_base 20^21: mod_base = OTHER; note = phosphorothioate linkage
  modified_base 21: mod_base = cm
  source 1..21: mol_type = other RNA
tagaaaacccaaatcctcatc

SEQ ID NO: 925 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = um
  modified_base 3^4: mod_base = OTHER; note = phosphorothioate linkage
  modified_base 4: mod_base = OTHER; note = 2'-fluoroguanosine
  modified_base 5: mod_base = um
  modified_base 6: mod_base = OTHER; note = 2'-fluoroadenosine
  modified_base 7: mod_base = OTHER; note = 2'-O-methyladenosine
  modified_base 8: mod_base = OTHER; note = 2'-fluorocytidine
  modified_base 9: mod_base = cm
  modified_base 10: mod_base = OTHER; note = 2'-fluoroguanosine
  modified_base 11: mod_base = um
  modified_base 12: mod_base = OTHER; note = 2'-fluorocytidine
  modified_base 13: mod_base = OTHER; note = 2'-O-methyladenosine
  modified_base 14: mod_base = OTHER; note = 2'-fluorouridine
  modified_base 15: mod_base = OTHER; note = 2'-O-methyladenosine
  modified_base 16: mod_base = OTHER; note = 2'-fluoroguanosine
  modified_base 17: mod_base = cm
  modified_base 18: mod_base = OTHER; note = 2'-fluoroadenosine
  modified_base 19: mod_base = gm
  modified_base 20: mod_base = OTHER; note = 2'-fluorouridine
  modified_base 20^21: mod_base = OTHER; note = phosphorothioate linkage
  modified_base 21: mod_base = gm
  source 1..21: mol_type = other RNA
agtgtaaccgtcatagcagtg

SEQ ID NO: 926 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = um
  modified_base 3^4: mod_base = OTHER; note = phosphorothioate linkage
  modified_base 4: mod_base = OTHER; note = 2'-fluoroguanosine
  modified_base 5: mod_base = OTHER; note = 2'-O-methyladenosine
  modified_base 6: mod_base = OTHER; note = 2'-fluorocytidine
  modified_base 7: mod_base = um
  modified_base 8: mod_base = OTHER; note = 2'-fluoroadenosine
  modified_base 9: mod_base = gm
  modified_base 10: mod_base = OTHER; note = 2'-fluoroadenosine
  modified_base 11: mod_base = cm
  modified_base 12: mod_base = OTHER; note = 2'-fluoroadenosine
  modified_base 13: mod_base = cm
  modified_base 14: mod_base = OTHER; note = 2'-fluorouridine
  modified_base 15: mod_base = um
  modified_base 16: mod_base = OTHER; note = 2'-fluorouridine
  modified_base 17: mod_base = um
  modified_base 18: mod_base = OTHER; note = 2'-fluorouridine
  modified_base 19: mod_base = gm
  modified_base 20: mod_base = OTHER; note = 2'-fluoroguanosine
  modified_base 20^21: mod_base = OTHER; note = phosphorothioate linkage
  modified_base 21: mod_base = cm
  source 1..21: mol_type = other RNA
tttgactagacactttttggc

SEQ ID NO: 927 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-fluorouridine
  modified_base 5: mod_base = um
  modified_base 6: mod_base = OTHER; note = 2'-fluoroguanosine
  modified_base 7: mod_base = OTHER; note = 2'-O-methyladenosine
  modified_base 8: mod_base = OTHER; note = 2'-fluorocytidine
  modified_base 9: mod_base = um
  modified_base 10: mod_base = OTHER; note = 2'-fluoroadenosine
  modified_base 11: mod_base = gm
  modified_base 12: mod_base = OTHER; note = 2'-fluoroadenosine
  modified_base 13: mod_base = cm
  modified_base 14: mod_base = OTHER; note = 2'-fluoroadenosine
  modified_base 15: mod_base = cm
  modified_base 16: mod_base = OTHER; note = 2'-fluorouridine
  modified_base 17: mod_base = um
  modified_base 18: mod_base = OTHER; note = 2'-fluorouridine
  modified_base 19: mod_base = um
  modified_base 20: mod_base = OTHER; note = 2'-fluorouridine
  modified_base 20^21: mod_base = OTHER; note = phosphorothioate linkage
  modified_base 21: mod_base = gm
  source 1..21: mol_type = other RNA
aagttgactagacactttttg

SEQ ID NO: 928 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluorocytidine
  modified_base 5: mod_base = OTHER; note = 2'-O-methyladenosine
  modified_base 6: mod_base = OTHER; note = 2'-fluorouridine
  modified_base 7: mod_base = OTHER; note = 2'-O-methyladenosine
  modified_base 8: mod_base = OTHER; note = 2'-fluoroadenosine
  modified_base 9: mod_base = cm
  modified_base 10: mod_base = OTHER; note = 2'-fluorouridine
  modified_base 11: mod_base = um
  modified_base 12: mod_base = OTHER; note = 2'-fluoroguanosine
  modified_base 13: mod_base = cm
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluorocytidine
  modified_base 17: mod_base = cm
  modified_base 18: mod_base = OTHER; note = 2'-fluorouridine
  modified_base 19: mod_base = um
  modified_base 20: mod_base = OTHER; note = 2'-fluorocytidine
  modified_base 20^21: mod_base = OTHER; note = phosphorothioate linkage
  modified_base 21: mod_base = um
  source 1..21: mol_type = other RNA
taccataacttgccaccttct

SEQ ID NO: 929 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluorouridine
  modified_base 5: mod_base = gm
  modified_base 6: mod_base = OTHER; note = 2'-fluorouridine
  modified_base 7: mod_base = um
  modified_base 8: mod_base = OTHER; note = 2'-fluoroguanosine
  modified_base 9: mod_base = um
  modified_base 10: mod_base = OTHER; note = 2'-fluoroguanosine
  modified_base 11: mod_base = cm
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = OTHER; note = 2'-fluorouridine
  modified_base 19: mod_base = cm
  modified_base 20: mod_base = OTHER; note = 2'-fluoroadenosine
  modified_base 20^21: mod_base = OTHER; note = phosphorothioate linkage
  modified_base 21: mod_base = gm
  source 1..21: mol_type = other RNA
tcatgttgtgcaatccatcag

SEQ ID NO: 930 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluorouridine
  modified_base 5: mod_base = cm
  modified_base 6: mod_base = OTHER; note = 2'-fluoroadenosine
  modified_base 7: mod_base = OTHER; note = 2'-O-methyladenosine
  modified_base 8: mod_base = OTHER; note = 2'-fluorouridine
  modified_base 9: mod_base = gm
  modified_base 10: mod_base = OTHER; note = 2'-fluoroadenosine
  modified_base 11: mod_base = cm
  modified_base 12: mod_base = OTHER; note = 2'-fluoroadenosine
  modified_base 13: mod_base = gm
  modified_base 14: mod_base = OTHER; note = 2'-fluorouridine
  modified_base 15: mod_base = OTHER; note = 2'-O-methyladenosine
  modified_base 16: mod_base = OTHER; note = 2'-fluoroadenosine
  modified_base 17: mod_base = um
  modified_base 18: mod_base = OTHER; note = 2'-fluorouridine
  modified_base 19: mod_base = gm
  modified_base 20: mod_base = OTHER; note = 2'-fluoroguanosine
  modified_base 20^21: mod_base = OTHER; note = phosphorothioate linkage
  modified_base 21: mod_base = gm
  source 1..21: mol_type = other RNA
tcatcaatgacagtaattggg

SEQ ID NO: 931 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluorouridine
  modified_base 5: mod_base = um
  modified_base 6: mod_base = OTHER; note = 2'-fluoroguanosine
  modified_base 7: mod_base = OTHER; note = 2'-O-methyladenosine
  modified_base 8: mod_base = OTHER; note = 2'-fluorouridine
  modified_base 9: mod_base = gm
  modified_base 10: mod_base = OTHER; note = 2'-fluorouridine
  modified_base 11: mod_base = um
  modified_base 12: mod_base = OTHER; note = 2'-fluorocytidine
  modified_base 13: mod_base = OTHER; note = 2'-O-methyladenosine
  modified_base 14: mod_base = OTHER; note = 2'-fluorocytidine
  modified_base 15: mod_base = um
  modified_base 16: mod_base = OTHER; note = 2'-fluorouridine
  modified_base 17: mod_base = gm
  modified_base 18: mod_base = OTHER; note = 2'-fluoroguanosine
  modified_base 19: mod_base = um
  modified_base 20: mod_base = OTHER; note = 2'-fluorouridine
  modified_base 20^21: mod_base = OTHER; note = phosphorothioate linkage
  modified_base 21: mod_base = cm
  source 1..21: mol_type = other RNA
tcattgatgttcacttggttc

SEQ ID NO: 932 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-fluorocytidine
  modified_base 5: mod_base = um
  modified_base 6: mod_base = OTHER; note = 2'-fluorouridine
  modified_base 7: mod_base = gm
  modified_base 8: mod_base = OTHER; note = 2'-fluorouridine
  modified_base 9: mod_base = gm
  modified_base 10: mod_base = OTHER; note = 2'-fluoroguanosine
  modified_base 11: mod_base = um
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluoroguanosine
  modified_base 17: mod_base = gm
  modified_base 18: mod_base = OTHER; note = 2'-fluorouridine
  modified_base 19: mod_base = OTHER; note = 2'-O-methyladenosine
  modified_base 20: mod_base = OTHER; note = 2'-fluorocytidine
  modified_base 20^21: mod_base = OTHER; note = phosphorothioate linkage
  modified_base 21: mod_base = cm
  source 1..21: mol_type = other RNA
ttgcttgtggtaatcggtacc

SEQ ID NO: 933 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = um
  modified_base 3^4: mod_base = OTHER; note = phosphorothioate linkage
  modified_base 4: mod_base = OTHER; note = 2'-fluorouridine
  modified_base 5: mod_base = gm
  modified_base 6: mod_base = OTHER; note = 2'-fluorocytidine
  modified_base 7: mod_base = um
  modified_base 8: mod_base = OTHER; note = 2'-fluorouridine
  modified_base 9: mod_base = gm
  modified_base 10: mod_base = OTHER; note = 2'-fluorouridine
  modified_base 11: mod_base = gm
  modified_base 12: mod_base = OTHER; note = 2'-fluoroguanosine
  modified_base 13: mod_base = um
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluorouridine
  modified_base 17: mod_base = cm
  modified_base 18: mod_base = OTHER; note = 2'-fluoroguanosine
  modified_base 19: mod_base = gm
  modified_base 20: mod_base = OTHER; note = 2'-fluorouridine
  modified_base 20^21: mod_base = OTHER; note = phosphorothioate linkage
  modified_base 21: mod_base = gm
  source 1..21: mol_type = other RNA
tgttgcttgtggtaatcggtg

SEQ ID NO: 934 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-fluoroadenosine
  modified_base 5: mod_base = gm
  modified_base 6: mod_base = OTHER; note = 2'-fluoroadenosine
  modified_base 7: mod_base = um
  modified_base 8: mod_base = OTHER; note = 2'-fluorocytidine
  modified_base 9: mod_base = um
  modified_base 10: mod_base = OTHER; note = 2'-fluorouridine
  modified_base 11: mod_base = gm
  modified_base 12: mod_base = OTHER; note = 2'-fluoroguanosine
  modified_base 13: mod_base = cm
  modified_base 14: mod_base = OTHER; note = 2'-fluorocytidine
  modified_base 15: mod_base = um
  modified_base 16: mod_base = OTHER; note = 2'-fluoroguanosine
  modified_base 17: mod_base = cm
  modified_base 18: mod_base = OTHER; note = 2'-fluorocytidine
  modified_base 19: mod_base = OTHER; note = 2'-O-methyladenosine
  modified_base 20: mod_base = OTHER; note = 2'-fluorouridine
  modified_base 20^21: mod_base = OTHER; note = phosphorothioate linkage
  modified_base 21: mod_base = gm
  source 1..21: mol_type = other RNA
ttgagatcttggcctgccatg

SEQ ID NO: 935 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = um
  modified_base 3^4: mod_base = OTHER; note = phosphorothioate linkage
  modified_base 4: mod_base = OTHER; note = 2'-fluorouridine
  modified_base 5: mod_base = gm
  modified_base 6: mod_base = OTHER; note = 2'-fluoroadenosine
  modified_base 7: mod_base = um
  modified_base 8: mod_base = OTHER; note = 2'-fluorocytidine
  modified_base 9: mod_base = OTHER; note = 2'-O-methyladenosine
  modified_base 10: mod_base = OTHER; note = 2'-fluoroguanosine
  modified_base 11: mod_base = gm
  modified_base 12: mod_base = OTHER; note = 2'-fluoroguanosine
  modified_base 13: mod_base = cm
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluorocytidine
  modified_base 17: mod_base = gm
  modified_base 18: mod_base = OTHER; note = 2'-fluorouridine
  modified_base 19: mod_base = cm
  modified_base 20: mod_base = OTHER; note = 2'-fluoroadenosine
  modified_base 20^21: mod_base = OTHER; note = phosphorothioate linkage
  modified_base 21: mod_base = cm
  source 1..21: mol_type = other RNA
tcttgatcagggcaacgtcac

SEQ ID NO: 936 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluorouridine
  modified_base 5: mod_base = um
  modified_base 6: mod_base = OTHER; note = 2'-fluoroguanosine
  modified_base 7: mod_base = OTHER; note = 2'-O-methyladenosine
  modified_base 8: mod_base = OTHER; note = 2'-fluorouridine
  modified_base 9: mod_base = cm
  modified_base 10: mod_base = OTHER; note = 2'-fluoroadenosine
  modified_base 11: mod_base = gm
  modified_base 12: mod_base = OTHER; note = 2'-fluoroguanosine
  modified_base 13: mod_base = gm
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluoroadenosine
  modified_base 17: mod_base = cm
  modified_base 18: mod_base = OTHER; note = 2'-fluoroguanosine
  modified_base 19: mod_base = um
  modified_base 20: mod_base = OTHER; note = 2'-fluorocytidine
  modified_base 20^21: mod_base = OTHER; note = phosphorothioate linkage
  modified_base 21: mod_base = OTHER; note = 2'-O-methyladenosine
  source 1..21: mol_type = other RNA
agcttgatcagggcaacgtca

SEQ ID NO: 937 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluoroguanosine
  modified_base 5: mod_base = cm
  modified_base 6: mod_base = OTHER; note = 2'-fluorocytidine
  modified_base 7: mod_base = OTHER; note = 2'-O-methyladenosine
  modified_base 8: mod_base = OTHER; note = 2'-fluoroguanosine
  modified_base 9: mod_base = OTHER; note = 2'-O-methyladenosine
  modified_base 10: mod_base = OTHER; note = 2'-fluoroadenosine
  modified_base 11: mod_base = gm
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluorocytidine
  modified_base 17: mod_base = OTHER; note = 2'-O-methyladenosine
  modified_base 18: mod_base = OTHER; note = 2'-fluorocytidine
  modified_base 19: mod_base = gm
  modified_base 20: mod_base = OTHER; note = 2'-fluorouridine
  modified_base 20^21: mod_base = OTHER; note = phosphorothioate linkage
  modified_base 21: mod_base = OTHER; note = 2'-O-methyladenosine
  source 1..21: mol_type = other RNA
taagccagaaggacacacgta

SEQ ID NO: 938 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluoroguanosine
  modified_base 5: mod_base = OTHER; note = 2'-O-methyladenosine
  modified_base 6: mod_base = OTHER; note = 2'-fluoroguanosine
  modified_base 7: mod_base = OTHER; note = 2'-O-methyladenosine
  modified_base 8: mod_base = OTHER; note = 2'-fluorouridine
  modified_base 9: mod_base = cm
  modified_base 10: mod_base = OTHER; note = 2'-fluorouridine
  modified_base 11: mod_base = cm
  modified_base 12: mod_base = OTHER; note = 2'-fluoroadenosine
  modified_base 13: mod_base = um
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluorocytidine
  modified_base 17: mod_base = um
  modified_base 18: mod_base = OTHER; note = 2'-fluorocytidine
  modified_base 19: mod_base = OTHER; note = 2'-O-methyladenosine
  modified_base 20: mod_base = OTHER; note = 2'-fluorocytidine
  modified_base 20^21: mod_base = OTHER; note = phosphorothioate linkage
  modified_base 21: mod_base = OTHER; note = 2'-O-methyladenosine
  source 1..21: mol_type = other RNA
aaagagatctcatcactcaca

SEQ ID NO: 939 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluoroadenosine
  modified_base 5: mod_base = OTHER; note = 2'-O-methyladenosine
  modified_base 6: mod_base = OTHER; note = 2'-fluoroguanosine
  modified_base 7: mod_base = OTHER; note = 2'-O-methyladenosine
  modified_base 8: mod_base = OTHER; note = 2'-fluoroguanosine
  modified_base 9: mod_base = OTHER; note = 2'-O-methyladenosine
  modified_base 10: mod_base = OTHER; note = 2'-fluorouridine
  modified_base 11: mod_base = cm
  modified_base 12: mod_base = OTHER; note = 2'-fluorouridine
  modified_base 13: mod_base = cm
  modified_base 14: mod_base = OTHER; note = 2'-fluoroadenosine
  modified_base 15: mod_base = um
  modified_base 16: mod_base = OTHER; note = 2'-fluorocytidine
  modified_base 17: mod_base = OTHER; note = 2'-O-methyladenosine
  modified_base 18: mod_base = OTHER; note = 2'-fluorocytidine
  modified_base 19: mod_base = um
  modified_base 20: mod_base = OTHER; note = 2'-fluorocytidine
  modified_base 20^21: mod_base = OTHER; note = phosphorothioate linkage
  modified_base 21: mod_base = OTHER; note = 2'-O-methyladenosine
  source 1..21: mol_type = other RNA
tgaaagagatctcatcactca

SEQ ID NO: 940 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluoroadenosine
  modified_base 5: mod_base = um
  modified_base 6: mod_base = OTHER; note = 2'-fluoroguanosine
  modified_base 7: mod_base = OTHER; note = 2'-O-methyladenosine
  modified_base 8: mod_base = OTHER; note = 2'-fluoroadenosine
  modified_base 9: mod_base = gm
  modified_base 10: mod_base = OTHER; note = 2'-fluoroguanosine
  modified_base 11: mod_base = OTHER; note = 2'-O-methyladenosine
  modified_base 12: mod_base = OTHER; note = 2'-fluoroguanosine
  modified_base 13: mod_base = um
  modified_base 14: mod_base = OTHER; note = 2'-fluorocytidine
  modified_base 15: mod_base = um
  modified_base 16: mod_base = OTHER; note = 2'-fluorouridine
  modified_base 17: mod_base = gm
  modified_base 18: mod_base = OTHER; note = 2'-fluoroguanosine
  modified_base 19: mod_base = cm
  modified_base 20: mod_base = OTHER; note = 2'-fluoroadenosine
  modified_base 20^21: mod_base = OTHER; note = phosphorothioate linkage
  modified_base 21: mod_base = gm
  source 1..21: mol_type = other RNA
tacatgaaggagtcttggcag

SEQ ID NO: 941 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-fluorouridine
  modified_base 5: mod_base = OTHER; note = 2'-O-methyladenosine
  modified_base 6: mod_base = OTHER; note = 2'-fluorocytidine
  modified_base 7: mod_base = OTHER; note = 2'-O-methyladenosine
  modified_base 8: mod_base = OTHER; note = 2'-fluorouridine
  modified_base 9: mod_base = gm
  modified_base 10: mod_base = OTHER; note = 2'-fluoroadenosine
  modified_base 11: mod_base = OTHER; note = 2'-O-methyladenosine
  modified_base 12: mod_base = OTHER; note = 2'-fluoroguanosine
  modified_base 13: mod_base = gm
  modified_base 14: mod_base = OTHER; note = 2'-fluoroadenosine
  modified_base 15: mod_base = gm
  modified_base 16: mod_base = OTHER; note = 2'-fluorouridine
  modified_base 17: mod_base = cm
  modified_base 18: mod_base = OTHER; note = 2'-fluorouridine
  modified_base 19: mod_base = um
  modified_base 20: mod_base = OTHER; note = 2'-fluoroguanosine
  modified_base 20^21: mod_base = OTHER; note = phosphorothioate linkage
  modified_base 21: mod_base = gm
  source 1..21: mol_type = other RNA
tcgtacatgaaggagtcttgg

SEQ ID NO: 942 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-fluorouridine
  modified_base 5: mod_base = cm
  modified_base 6: mod_base = OTHER; note = 2'-fluoroguanosine
  modified_base 7: mod_base = um
  modified_base 8: mod_base = OTHER; note = 2'-fluoroadenosine
  modified_base 9: mod_base = cm
  modified_base 10: mod_base = OTHER; note = 2'-fluoroadenosine
  modified_base 11: mod_base = um
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-fluoroadenosine
  modified_base 15: mod_base = gm
  modified_base 16: mod_base = OTHER; note = 2'-fluoroguanosine
  modified_base 17: mod_base = OTHER; note = 2'-O-methyladenosine
  modified_base 18: mod_base = OTHER; note = 2'-fluoroguanosine
  modified_base 19: mod_base = um
  modified_base 20: mod_base = OTHER; note = 2'-fluorocytidine
  modified_base 20^21: mod_base = OTHER; note = phosphorothioate linkage
  modified_base 21: mod_base = um
  source 1..21: mol_type = other RNA
ttgtcgtacatgaaggagtct

SEQ ID NO: 943 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluoroguanosine
  modified_base 5: mod_base = OTHER; note = 2'-O-methyladenosine
  modified_base 6: mod_base = OTHER; note = 2'-fluorocytidine
  modified_base 7: mod_base = um
  modified_base 8: mod_base = OTHER; note = 2'-fluorocytidine
  modified_base 9: mod_base = cm
  modified_base 10: mod_base = OTHER; note = 2'-fluorouridine
  modified_base 11: mod_base = um
  modified_base 12: mod_base = OTHER; note = 2'-fluorocytidine
  modified_base 13: mod_base = um
  modified_base 14: mod_base = OTHER; note = 2'-fluoroadenosine
  modified_base 15: mod_base = um
  modified_base 16: mod_base = OTHER; note = 2'-fluoroguanosine
  modified_base 17: mod_base = gm
  modified_base 18: mod_base = OTHER; note = 2'-fluorouridine
  modified_base 19: mod_base = cm
  modified_base 20: mod_base = OTHER; note = 2'-fluorouridine
  modified_base 20^21: mod_base = OTHER; note = phosphorothioate linkage
  modified_base 21: mod_base = cm
  source 1..21: mol_type = other RNA
atcgactccttctatggtctc

SEQ ID NO: 944 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluoroguanosine
  modified_base 5: mod_base = gm
  modified_base 6: mod_base = OTHER; note = 2'-fluorouridine
  modified_base 7: mod_base = OTHER; note = 2'-O-methyladenosine
  modified_base 8: mod_base = OTHER; note = 2'-fluoroguanosine
  modified_base 9: mod_base = OTHER; note = 2'-O-methyladenosine
  modified_base 10: mod_base = OTHER; note = 2'-fluorouridine
  modified_base 11: mod_base = gm
  modified_base 12: mod_base = OTHER; note = 2'-fluorouridine
  modified_base 13: mod_base = um
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluorouridine
  modified_base 17: mod_base = gm
  modified_base 18: mod_base = OTHER; note = 2'-fluoroguanosine
  modified_base 19: mod_base = OTHER; note = 2'-O-methyladenosine
  modified_base 20: mod_base = OTHER; note = 2'-fluoroguanosine
  modified_base 20^21: mod_base = OTHER; note = phosphorothioate linkage
  modified_base 21: mod_base = cm
  source 1..21: mol_type = other RNA
tcaggtagatgttcatggagc

SEQ ID NO: 945 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = um
  modified_base 3^4: mod_base = OTHER; note = phosphorothioate linkage
  modified_base 4: mod_base = OTHER; note = 2'-fluoroadenosine
  modified_base 5: mod_base = gm
  modified_base 6: mod_base = OTHER; note = 2'-fluorocytidine
  modified_base 7: mod_base = OTHER; note = 2'-O-methyladenosine
  modified_base 8: mod_base = OTHER; note = 2'-fluorocytidine
  modified_base 9: mod_base = cm
  modified_base 10: mod_base = OTHER; note = 2'-fluoroadenosine
  modified_base 11: mod_base = gm
  modified_base 12: mod_base = OTHER; note = 2'-fluoroguanosine
  modified_base 13: mod_base = um
  modified_base 14: mod_base = OTHER; note = 2'-fluoroadenosine
  modified_base 15: mod_base = gm
  modified_base 16: mod_base = OTHER; note = 2'-fluoroadenosine
  modified_base 17: mod_base = um
  modified_base 18: mod_base = OTHER; note = 2'-fluoroguanosine
  modified_base 19: mod_base = um
  modified_base 20: mod_base = OTHER; note = 2'-fluorouridine
  modified_base 20^21: mod_base = OTHER; note = phosphorothioate linkage
  modified_base 21: mod_base = cm
  source 1..21: mol_type = other RNA
tctagcaccaggtagatgttc

SEQ ID NO: 946 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluorocytidine
  modified_base 5: mod_base = OTHER; note = 2'-O-methyladenosine
  modified_base 6: mod_base = OTHER; note = 2'-fluoroadenosine
  modified_base 7: mod_base = um
  modified_base 8: mod_base = OTHER; note = 2'-fluoroguanosine
  modified_base 9: mod_base = cm
  modified_base 10: mod_base = OTHER; note = 2'-fluorouridine
  modified_base 11: mod_base = gm
  modified_base 12: mod_base = OTHER; note = 2'-fluorouridine
  modified_base 13: mod_base = cm
  modified_base 14: mod_base = OTHER; note = 2'-fluorouridine
  modified_base 15: mod_base = gm
  modified_base 16: mod_base = OTHER; note = 2'-fluoroadenosine
  modified_base 17: mod_base = um
  modified_base 18: mod_base = OTHER; note = 2'-fluorocytidine
  modified_base 19: mod_base = cm
  modified_base 20: mod_base = OTHER; note = 2'-fluoroadenosine
  modified_base 20^21: mod_base = OTHER; note = phosphorothioate linkage
  modified_base 21: mod_base = cm
  source 1..21: mol_type = other RNA
tcccaatgctgtctgatccac

SEQ ID NO: 947 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluorocytidine
  modified_base 5: mod_base = um
  modified_base 6: mod_base = OTHER; note = 2'-fluoroadenosine
  modified_base 7: mod_base = gm
  modified_base 8: mod_base = OTHER; note = 2'-fluoroadenosine
  modified_base 9: mod_base = cm
  modified_base 10: mod_base = OTHER; note = 2'-fluoroadenosine
  modified_base 11: mod_base = cm
  modified_base 12: mod_base = OTHER; note = 2'-fluorouridine
  modified_base 13: mod_base = um
  modified_base 14: mod_base = OTHER; note = 2'-fluorouridine
  modified_base 15: mod_base = um
  modified_base 16: mod_base = OTHER; note = 2'-fluorouridine
  modified_base 17: mod_base = gm
  modified_base 18: mod_base = OTHER; note = 2'-fluoroguanosine
  modified_base 19: mod_base = cm
  modified_base 20: mod_base = OTHER; note = 2'-fluorouridine
  modified_base 20^21: mod_base = OTHER; note = phosphorothioate linkage
  modified_base 21: mod_base = cm
  source 1..21: mol_type = other RNA
tgactagacactttttggctc

SEQ ID NO: 948 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluoroadenosine
  modified_base 5: mod_base = um
  modified_base 6: mod_base = OTHER; note = 2'-fluoroadenosine
  modified_base 7: mod_base = OTHER; note = 2'-O-methyladenosine
  modified_base 8: mod_base = OTHER; note = 2'-fluorocytidine
  modified_base 9: mod_base = um
  modified_base 10: mod_base = OTHER; note = 2'-fluorouridine
  modified_base 11: mod_base = gm
  modified_base 12: mod_base = OTHER; note = 2'-fluorocytidine
  modified_base 13: mod_base = cm
  modified_base 14: mod_base = OTHER; note = 2'-fluoroadenosine
  modified_base 15: mod_base = cm
  modified_base 16: mod_base = OTHER; note = 2'-fluorocytidine
  modified_base 17: mod_base = um
  modified_base 18: mod_base = OTHER; note = 2'-fluorouridine
  modified_base 19: mod_base = cm
  modified_base 20: mod_base = OTHER; note = 2'-fluorouridine
  modified_base 20^21: mod_base = OTHER; note = phosphorothioate linkage
  modified_base 21: mod_base = cm
  source 1..21: mol_type = other RNA
accataacttgccaccttctc

SEQ ID NO: 949 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = um
  modified_base 3^4: mod_base = OTHER; note = phosphorothioate linkage
  modified_base 4: mod_base = OTHER; note = 2'-fluoroguanosine
  modified_base 5: mod_base = gm
  modified_base 6: mod_base = OTHER; note = 2'-fluorocytidine
  modified_base 7: mod_base = um
  modified_base 8: mod_base = OTHER; note = 2'-fluorouridine
  modified_base 9: mod_base = cm
  modified_base 10: mod_base = OTHER; note = 2'-fluoroadenosine
  modified_base 11: mod_base = cm
  modified_base 12: mod_base = OTHER; note = 2'-fluoroadenosine
  modified_base 13: mod_base = cm
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluorouridine
  modified_base 17: mod_base = OTHER; note = 2'-O-methyladenosine
  modified_base 18: mod_base = OTHER; note = 2'-fluoroadenosine
  modified_base 19: mod_base = cm
  modified_base 20: mod_base = OTHER; note = 2'-fluorouridine
  modified_base 20^21: mod_base = OTHER; note = phosphorothioate linkage
  modified_base 21: mod_base = cm
  source 1..21: mol_type = other RNA
tttggcttcacaccataactc

SEQ ID NO: 950 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluorouridine
  modified_base 5: mod_base = cm
  modified_base 6: mod_base = OTHER; note = 2'-fluoroadenosine
  modified_base 7: mod_base = um
  modified_base 8: mod_base = OTHER; note = 2'-fluoroguanosine
  modified_base 9: mod_base = cm
  modified_base 10: mod_base = OTHER; note = 2'-fluorouridine
  modified_base 11: mod_base = gm
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluorocytidine
  modified_base 17: mod_base = um
  modified_base 18: mod_base = OTHER; note = 2'-fluoroguanosine
  modified_base 19: mod_base = cm
  modified_base 20: mod_base = OTHER; note = 2'-fluorocytidine
  modified_base 20^21: mod_base = OTHER; note = phosphorothioate linkage
  modified_base 21: mod_base = um
  source 1..21: mol_type = other RNA
tcatcatgctgtacactgcct

SEQ ID NO: 951 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluoroadenosine
  modified_base 5: mod_base = um
  modified_base 6: mod_base = OTHER; note = 2'-fluoroguanosine
  modified_base 7: mod_base = OTHER; note = 2'-O-methyladenosine
  modified_base 8: mod_base = OTHER; note = 2'-fluorocytidine
  modified_base 9: mod_base = OTHER; note = 2'-O-methyladenosine
  modified_base 10: mod_base = OTHER; note = 2'-fluoroguanosine
  modified_base 11: mod_base = um
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = um
  modified_base 16: mod_base = OTHER; note = 2'-fluoroguanosine
  modified_base 17: mod_base = gm
  modified_base 18: mod_base = OTHER; note = 2'-fluoroguanosine
  modified_base 19: mod_base = um
  modified_base 20: mod_base = OTHER; note = 2'-fluorocytidine
  modified_base 20^21: mod_base = OTHER; note = phosphorothioate linkage
  modified_base 21: mod_base = cm
  source 1..21: mol_type = other RNA
tcaatgacagtaattgggtcc

SEQ ID NO: 952 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluorouridine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluoroadenosine
  modified_base 5: mod_base = OTHER; note = 2'-O-methyladenosine
  modified_base 6: mod_base = OTHER; note = 2'-fluorouridine
  modified_base 7: mod_base = gm
  modified_base 8: mod_base = OTHER; note = 2'-fluoroadenosine
  modified_base 9: mod_base = cm
  modified_base 10: mod_base = OTHER; note = 2'-fluoroadenosine
  modified_base 11: mod_base = gm
  modified_base 12: mod_base = OTHER; note = 2'-fluorouridine
  modified_base 13: mod_base = OTHER; note = 2'-O-methyladenosine
  modified_base 14: mod_base = OTHER; note = 2'-fluoroadenosine
  modified_base 15: mod_base = um
  modified_base 16: mod_base = OTHER; note = 2'-fluorouridine
  modified_base 17: mod_base = gm
  modified_base 18: mod_base = OTHER; note = 2'-fluoroguanosine
  modified_base 19: mod_base = gm
  modified_base 20: mod_base = OTHER; note = 2'-fluorouridine
  modified_base 20^21: mod_base = OTHER; note = phosphorothioate linkage
  modified_base 21: mod_base = cm
  source 1..21: mol_type = other RNA
atcaatgacagtaattgggtc

SEQ ID NO: 953 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-fluoroadenosine
  modified_base 5: mod_base = um
  modified_base 6: mod_base = OTHER; note = 2'-fluorocytidine
  modified_base 7: mod_base = um
  modified_base 8: mod_base = OTHER; note = 2'-fluorocytidine
  modified_base 9: mod_base = OTHER; note = 2'-O-methyladenosine
  modified_base 10: mod_base = OTHER; note = 2'-fluorouridine
  modified_base 11: mod_base = cm
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = gm
  modified_base 16: mod_base = OTHER; note = 2'-fluoroadenosine
  modified_base 17: mod_base = cm
  modified_base 18: mod_base = OTHER; note = 2'-fluoroadenosine
  modified_base 19: mod_base = gm
  modified_base 20: mod_base = OTHER; note = 2'-fluorouridine
  modified_base 20^21: mod_base = OTHER; note = phosphorothioate linkage
  modified_base 21: mod_base = gm
  source 1..21: mol_type = other RNA
tggatctcatcaatgacagtg

SEQ ID NO: 954 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-fluoroadenosine
  modified_base 5: mod_base = cm
  modified_base 6: mod_base = OTHER; note = 2'-fluoroadenosine
  modified_base 7: mod_base = um
  modified_base 8: mod_base = OTHER; note = 2'-fluorocytidine
  modified_base 9: mod_base = cm
  modified_base 10: mod_base = OTHER; note = 2'-fluoroadenosine
  modified_base 11: mod_base = gm
  modified_base 12: mod_base = OTHER; note = 2'-fluoroadenosine
  modified_base 13: mod_base = um
  modified_base 14: mod_base = OTHER; note = 2'-fluoroadenosine
  modified_base 15: mod_base = OTHER; note = 2'-O-methyladenosine
  modified_base 16: mod_base = OTHER; note = 2'-fluorouridine
  modified_base 17: mod_base = cm
  modified_base 18: mod_base = OTHER; note = 2'-fluorocytidine
  modified_base 19: mod_base = um
  modified_base 20: mod_base = OTHER; note = 2'-fluorocytidine
  modified_base 20^21: mod_base = OTHER; note = phosphorothioate linkage
  modified_base 21: mod_base = cm
  source 1..21: mol_type = other RNA
tagacatccagataatcctcc

SEQ ID NO: 955 - DNA, 21 bp, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluorocytidine
  modified_base 5: mod_base = OTHER; note = 2'-O-methyladenosine
  modified_base 6: mod_base = OTHER; note = 2'-fluorocytidine
  modified_base 7: mod_base = OTHER; note = 2'-O-methyladenosine
  modified_base 8: mod_base = OTHER; note = 2'-fluorouridine
  modified_base 9: mod_base = OTHER; note = 2'-O-methyladenosine
  modified_base 10: mod_base = OTHER; note = 2'-fluoroguanosine
  modified_base 11: mod_base = OTHER; note = 2'-O-methyladenosine
  modified_base 12: mod_base = OTHER; note = 2'-fluorocytidine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = OTHER; note = 2'-fluoroguanosine
  modified_base 19: mod_base = OTHER; note = 2'-O-methyladenosine
  modified_base 20: mod_base = OTHER; note = 2'-fluorouridine
  modified_base 20^21: mod_base = OTHER; note = phosphorothioate linkage
  modified_base 21: mod_base = gm
  source 1..21: mol_type = other DNA
aaacacatagacatccagatg

SEQ ID NO: 956 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluoroadenosine
  modified_base 5: mod_base = OTHER; note = 2'-O-methyladenosine
  modified_base 6: mod_base = OTHER; note = 2'-fluorocytidine
  modified_base 7: mod_base = OTHER; note = 2'-O-methyladenosine
  modified_base 8: mod_base = OTHER; note = 2'-fluorocytidine
  modified_base 9: mod_base = OTHER; note = 2'-O-methyladenosine
  modified_base 10: mod_base = OTHER; note = 2'-fluorouridine
  modified_base 11: mod_base = OTHER; note = 2'-O-methyladenosine
  modified_base 12: mod_base = OTHER; note = 2'-fluoroguanosine
  modified_base 13: mod_base = OTHER; note = 2'-O-methyladenosine
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluorouridine
  modified_base 17: mod_base = cm
  modified_base 18: mod_base = OTHER; note = 2'-fluorocytidine
  modified_base 19: mod_base = OTHER; note = 2'-O-methyladenosine
  modified_base 20: mod_base = OTHER; note = 2'-fluoroguanosine
  modified_base 20^21: mod_base = OTHER; note = phosphorothioate linkage
  modified_base 21: mod_base = OTHER; note = 2'-O-methyladenosine
  source 1..21: mol_type = other RNA
tcaaacacatagacatccaga

SEQ ID NO: 957 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluoroguanosine
  modified_base 5: mod_base = cm
  modified_base 6: mod_base = OTHER; note = 2'-fluoroadenosine
  modified_base 7: mod_base = um
  modified_base 8: mod_base = OTHER; note = 2'-fluorouridine
  modified_base 9: mod_base = gm
  modified_base 10: mod_base = OTHER; note = 2'-fluoroadenosine
  modified_base 11: mod_base = um
  modified_base 12: mod_base = OTHER; note = 2'-fluoroguanosine
  modified_base 13: mod_base = um
  modified_base 14: mod_base = OTHER; note = 2'-fluorouridine
  modified_base 15: mod_base = cm
  modified_base 16: mod_base = OTHER; note = 2'-fluoroadenosine
  modified_base 17: mod_base = cm
  modified_base 18: mod_base = OTHER; note = 2'-fluorouridine
  modified_base 19: mod_base = um
  modified_base 20: mod_base = OTHER; note = 2'-fluoroguanosine
  modified_base 20^21: mod_base = OTHER; note = phosphorothioate linkage
  modified_base 21: mod_base = gm
  source 1..21: mol_type = other RNA
aaagcattgatgttcacttgg

SEQ ID NO: 958 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluorocytidine
  modified_base 5: mod_base = OTHER; note = 2'-O-methyladenosine
  modified_base 6: mod_base = OTHER; note = 2'-fluoroadenosine
  modified_base 7: mod_base = OTHER; note = 2'-O-methyladenosine
  modified_base 8: mod_base = OTHER; note = 2'-fluoroguanosine
  modified_base 9: mod_base = cm
  modified_base 10: mod_base = OTHER; note = 2'-fluoroadenosine
  modified_base 11: mod_base = um
  modified_base 12: mod_base = OTHER; note = 2'-fluorouridine
  modified_base 13: mod_base = gm
  modified_base 14: mod_base = OTHER; note = 2'-fluoroadenosine
  modified_base 15: mod_base = um
  modified_base 16: mod_base = OTHER; note = 2'-fluoroguanosine
  modified_base 17: mod_base = um
  modified_base 18: mod_base = OTHER; note = 2'-fluorouridine
  modified_base 19: mod_base = cm
  modified_base 20: mod_base = OTHER; note = 2'-fluoroadenosine
  modified_base 20^21: mod_base = OTHER; note = phosphorothioate linkage
  modified_base 21: mod_base = cm
  source 1..21: mol_type = other RNA
agccaaagcattgatgttcac

SEQ ID NO: 959 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluoroguanosine
  modified_base 5: mod_base = cm
  modified_base 6: mod_base = OTHER; note = 2'-fluorocytidine
  modified_base 7: mod_base = OTHER; note = 2'-O-methyladenosine
  modified_base 8: mod_base = OTHER; note = 2'-fluoroadenosine
  modified_base 9: mod_base = OTHER; note = 2'-O-methyladenosine
  modified_base 10: mod_base = OTHER; note = 2'-fluoroguanosine
  modified_base 11: mod_base = cm
  modified_base 12: mod_base = OTHER; note = 2'-fluoroadenosine
  modified_base 13: mod_base = um
  modified_base 14: mod_base = OTHER; note = 2'-fluorouridine
  modified_base 15: mod_base = gm
  modified_base 16: mod_base = OTHER; note = 2'-fluoroadenosine
  modified_base 17: mod_base = um
  modified_base 18: mod_base = OTHER; note = 2'-fluoroguanosine
  modified_base 19: mod_base = um
  modified_base 20: mod_base = OTHER; note = 2'-fluorouridine
  modified_base 20^21: mod_base = OTHER; note = phosphorothioate linkage
  modified_base 21: mod_base = cm
  source 1..21: mol_type = other RNA
taagccaaagcattgatgttc

SEQ ID NO: 960 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = um
  modified_base 3^4: mod_base = OTHER; note = phosphorothioate linkage
  modified_base 4: mod_base = OTHER; note = 2'-fluorouridine
  modified_base 5: mod_base = gm
  modified_base 6: mod_base = OTHER; note = 2'-fluorocytidine
  modified_base 7: mod_base = um
  modified_base 8: mod_base = OTHER; note = 2'-fluorocytidine
  modified_base 9: mod_base = OTHER; note = 2'-O-methyladenosine
  modified_base 10: mod_base = OTHER; note = 2'-fluorouridine
  modified_base 11: mod_base = um
  modified_base 12: mod_base = OTHER; note = 2'-fluoroguanosine
  modified_base 13: mod_base = um
  modified_base 14: mod_base = OTHER; note = 2'-fluorocytidine
  modified_base 15: mod_base = um
  modified_base 16: mod_base = OTHER; note = 2'-fluorouridine
  modified_base 17: mod_base = um
  modified_base 18: mod_base = OTHER; note = 2'-fluorocytidine
  modified_base 19: mod_base = um
  modified_base 20: mod_base = OTHER; note = 2'-fluorouridine
  modified_base 20^21: mod_base = OTHER; note = phosphorothioate linkage
  modified_base 21: mod_base = gm
  source 1..21: mol_type = other RNA
tgttgctcattgtctttcttg

SEQ ID NO: 961 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluorouridine
  modified_base 5: mod_base = gm
  modified_base 6: mod_base = OTHER; note = 2'-fluorouridine
  modified_base 7: mod_base = um
  modified_base 8: mod_base = OTHER; note = 2'-fluoroguanosine
  modified_base 9: mod_base = cm
  modified_base 10: mod_base = OTHER; note = 2'-fluorouridine
  modified_base 11: mod_base = cm
  modified_base 12: mod_base = OTHER; note = 2'-fluoroadenosine
  modified_base 13: mod_base = um
  modified_base 14: mod_base = OTHER; note = 2'-fluorouridine
  modified_base 15: mod_base = gm
  modified_base 16: mod_base = OTHER; note = 2'-fluorouridine
  modified_base 17: mod_base = cm
  modified_base 18: mod_base = OTHER; note = 2'-fluorouridine
  modified_base 19: mod_base = um
  modified_base 20: mod_base = OTHER; note = 2'-fluorouridine
  modified_base 20^21: mod_base = OTHER; note = phosphorothioate linkage
  modified_base 21: mod_base = cm
  source 1..21: mol_type = other RNA
acatgttgctcattgtctttc

SEQ ID NO: 962 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = cm
  modified_base 3^4: mod_base = OTHER; note = phosphorothioate linkage
  modified_base 4: mod_base = OTHER; note = 2'-fluoroadenosine
  modified_base 5: mod_base = cm
  modified_base 6: mod_base = OTHER; note = 2'-fluoroadenosine
  modified_base 7: mod_base = OTHER; note = 2'-O-methyladenosine
  modified_base 8: mod_base = OTHER; note = 2'-fluoroadenosine
  modified_base 9: mod_base = gm
  modified_base 10: mod_base = OTHER; note = 2'-fluorouridine
  modified_base 11: mod_base = OTHER; note = 2'-O-methyladenosine
  modified_base 12: mod_base = OTHER; note = 2'-fluorocytidine
  modified_base 13: mod_base = um
  modified_base 14: mod_base = OTHER; note = 2'-fluorocytidine
  modified_base 15: mod_base = OTHER; note = 2'-O-methyladenosine
  modified_base 16: mod_base = OTHER; note = 2'-fluoroguanosine
  modified_base 17: mod_base = OTHER; note = 2'-O-methyladenosine
  modified_base 18: mod_base = OTHER; note = 2'-fluorocytidine
  modified_base 19: mod_base = OTHER; note = 2'-O-methyladenosine
  modified_base 20: mod_base = OTHER; note = 2'-fluorocytidine
  modified_base 20^21: mod_base = OTHER; note = phosphorothioate linkage
  modified_base 21: mod_base = cm
  source 1..21: mol_type = other RNA
agcacaaagtactcagacacc

SEQ ID NO: 963 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-fluorocytidine
  modified_base 5: mod_base = OTHER; note = 2'-O-methyladenosine
  modified_base 6: mod_base = OTHER; note = 2'-fluorocytidine
  modified_base 7: mod_base = OTHER; note = 2'-O-methyladenosine
  modified_base 8: mod_base = OTHER; note = 2'-fluoroadenosine
  modified_base 9: mod_base = OTHER; note = 2'-O-methyladenosine
  modified_base 10: mod_base = OTHER; note = 2'-fluoroguanosine
  modified_base 11: mod_base = um
  modified_base 12: mod_base = OTHER; note = 2'-fluoroadenosine
  modified_base 13: mod_base = cm
  modified_base 14: mod_base = OTHER; note = 2'-fluorouridine
  modified_base 15: mod_base = cm
  modified_base 16: mod_base = OTHER; note = 2'-fluoroadenosine
  modified_base 17: mod_base = gm
  modified_base 18: mod_base = OTHER; note = 2'-fluoroadenosine
  modified_base 19: mod_base = cm
  modified_base 20: mod_base = OTHER; note = 2'-fluoroadenosine
  modified_base 20^21: mod_base = OTHER; note = phosphorothioate linkage
  modified_base 21: mod_base = cm
  source 1..21: mol_type = other RNA
tagcacaaagtactcagacac

SEQ ID NO: 964 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluorocytidine
  modified_base 5: mod_base = OTHER; note = 2'-O-methyladenosine
  modified_base 6: mod_base = OTHER; note = 2'-fluoroadenosine
  modified_base 7: mod_base = um
  modified_base 8: mod_base = OTHER; note = 2'-fluoroguanosine
  modified_base 9: mod_base = um
  modified_base 10: mod_base = OTHER; note = 2'-fluoroguanosine
  modified_base 11: mod_base = cm
  modified_base 12: mod_base = OTHER; note = 2'-fluorouridine
  modified_base 13: mod_base = gm
  modified_base 14: mod_base = OTHER; note = 2'-fluorocytidine
  modified_base 15: mod_base = um
  modified_base 16: mod_base = OTHER; note = 2'-fluoroguanosine
  modified_base 17: mod_base = um
  modified_base 18: mod_base = OTHER; note = 2'-fluorocytidine
  modified_base 19: mod_base = OTHER; note = 2'-O-methyladenosine
  modified_base 20: mod_base = OTHER; note = 2'-fluoroguanosine
  modified_base 20^21: mod_base = OTHER; note = phosphorothioate linkage
  modified_base 21: mod_base = cm
  source 1..21: mol_type = other RNA
aaacaatgtgctgctgtcagc

SEQ ID NO: 965 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluoroguanosine
  modified_base 5: mod_base = um
  modified_base 6: mod_base = OTHER; note = 2'-O-methyladenosine
  modified_base 7: mod_base = cm
  modified_base 8: mod_base = um
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = cm
  modified_base 14: mod_base = OTHER; note = 2'-fluoroadenosine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = cm
  source 1..21: mol_type = other RNA
aaagtactcagacaccacagc

SEQ ID NO: 966 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = gm
  modified_base 5: mod_base = OTHER; note = 2'-fluorouridine
  modified_base 6: mod_base = OTHER; note = 2'-O-methyladenosine
  modified_base 7: mod_base = cm
  modified_base 8: mod_base = um
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = cm
  modified_base 14: mod_base = OTHER; note = 2'-fluoroadenosine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = cm
  source 1..21: mol_type = other RNA
aaagtactcagacaccacagc

SEQ ID NO: 967 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = gm
  modified_base 5: mod_base = um
  modified_base 6: mod_base = OTHER; note = 2'-O-methyladenosine
  modified_base 7: mod_base = OTHER; note = 2'-fluorocytidine
  modified_base 8: mod_base = um
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = cm
  modified_base 14: mod_base = OTHER; note = 2'-fluoroadenosine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = cm
  source 1..21: mol_type = other RNA
aaagtactcagacaccacagc

SEQ ID NO: 968 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = gm
  modified_base 5: mod_base = um
  modified_base 6: mod_base = OTHER; note = 2'-O-methyladenosine
  modified_base 7: mod_base = cm
  modified_base 8: mod_base = um
  modified_base 9: mod_base = OTHER; note = 2'-fluorocytidine
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = cm
  modified_base 14: mod_base = OTHER; note = 2'-fluoroadenosine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = cm
  source 1..21: mol_type = other RNA
aaagtactcagacaccacagc

SEQ ID NO: 969 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluoroguanosine
  modified_base 5: mod_base = um
  modified_base 6: mod_base = OTHER; note = 2'-fluoroadenosine
  modified_base 7: mod_base = cm
  modified_base 8: mod_base = um
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-O-methyladenosine
  modified_base 13: mod_base = cm
  modified_base 14: mod_base = OTHER; note = 2'-fluoroadenosine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = cm
  source 1..21: mol_type = other RNA
aaagtactcagacaccacagc

SEQ ID NO: 970 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = gm
  modified_base 5: mod_base = um
  modified_base 6: mod_base = OTHER; note = 2'-fluoroadenosine
  modified_base 7: mod_base = cm
  modified_base 8: mod_base = um
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-O-methyladenosine
  modified_base 13: mod_base = cm
  modified_base 14: mod_base = OTHER; note = 2'-fluoroadenosine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = cm
  source 1..21: mol_type = other RNA
aaagtactcagacaccacagc

SEQ ID NO: 971 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = gm
  modified_base 5: mod_base = um
  modified_base 6: mod_base = OTHER; note = 2'-O-methyladenosine
  modified_base 7: mod_base = cm
  modified_base 8: mod_base = um
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = cm
  modified_base 14: mod_base = OTHER; note = 2'-fluoroadenosine
  modified_base 15: mod_base = cm
  modified_base 16: mod_base = cm
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = cm
  source 1..21: mol_type = other RNA
aaagtactcagacaccacagc

SEQ ID NO: 972 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = gm
  modified_base 5: mod_base = um
  modified_base 6: mod_base = OTHER; note = 2'-O-methyladenosine
  modified_base 7: mod_base = cm
  modified_base 8: mod_base = um
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-O-methyladenosine
  modified_base 13: mod_base = cm
  modified_base 14: mod_base = OTHER; note = 2'-fluoroadenosine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = cm
  source 1..21: mol_type = other RNA
aaagtactcagacaccacagc

SEQ ID NO: 973 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = gm
  modified_base 5: mod_base = OTHER; note = 2'-fluorouridine
  modified_base 6: mod_base = OTHER; note = 2'-O-methyladenosine
  modified_base 7: mod_base = cm
  modified_base 8: mod_base = um
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-O-methyladenosine
  modified_base 13: mod_base = cm
  modified_base 14: mod_base = OTHER; note = 2'-fluoroadenosine
  modified_base 15: mod_base = cm
  modified_base 16: mod_base = cm
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = cm
  source 1..21: mol_type = other RNA
aaagtactcagacaccacagc

SEQ ID NO: 974 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 4: mod_base = OTHER; note = 2'-fluoroguanosine
  modified_base 5: mod_base = um
  modified_base 6: mod_base = OTHER; note = 2'-O-methyladenosine
  modified_base 7: mod_base = cm
  modified_base 8: mod_base = um
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = cm
  modified_base 14: mod_base = OTHER; note = 2'-fluoroadenosine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = cm
  source 1..21: mol_type = other RNA
aaagtactcagacaccacagc

SEQ ID NO: 975 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroadenosine
  modified_base 3: mod_base = OTHER; note = 2'-O-methyladenosine
  modified_base 4: mod_base = OTHER; note = 2'-fluoroguanosine
  modified_base 5: mod_base = um
  modified_base 6: mod_base = OTHER; note = 2'-O-methyladenosine
  modified_base 7: mod_base = cm
  modified_base 8: mod_base = um
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = cm
  modified_base 14: mod_base = OTHER; note = 2'-fluoroadenosine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = gm
  modified_base 20^21: mod_base = OTHER; note = phosphorodithioate linkage
  modified_base 21: mod_base = cm
  source 1..21: mol_type = other RNA
aaagtactcagacaccacagc

SEQ ID NO: 976 - RNA, 21 nt, synthetic construct
  modified_base 1: mod_base = OTHER; note = 5'-cyclopropyl phosphonate-2'-O-methyladenosine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluoroguanosine
  modified_base 5: mod_base = um
  modified_base 6: mod_base = OTHER; note = 2'-O-methyladenosine
  modified_base 7: mod_base = cm
  modified_base 8: mod_base = um
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = cm
  modified_base 14: mod_base = OTHER; note = 2'-fluoroadenosine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = cm
  source 1..21: mol_type = other RNA
aaagtactcagacaccacagc

SEQ ID NO: 977 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 3: mod_base = gm
  modified_base 4: mod_base = OTHER; note = 2'-O-methyladenosine
  modified_base 5: mod_base = OTHER; note = 2'-fluoroadenosine
  modified_base 6: mod_base = OTHER; note = 2'-O-methyladenosine
  modified_base 7: mod_base = OTHER; note = 2'-O-methyladenosine
  modified_base 8: mod_base = cm
  modified_base 9: mod_base = cm
  modified_base 10: mod_base = cm
  modified_base 11: mod_base = OTHER; note = 2'-O-methyladenosine
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluorocytidine
  modified_base 17: mod_base = um
  modified_base 18: mod_base = cm
  modified_base 19: mod_base = OTHER; note = 2'-O-methyladenosine
  modified_base 20: mod_base = um
  modified_base 20^21: mod_base = OTHER; note = phosphorodithioate linkage
  modified_base 21: mod_base = cm
  source 1..21: mol_type = other RNA
tagaaaacccaaatcctcatc

SEQ ID NO: 978 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 3: mod_base = gm
  modified_base 4: mod_base = OTHER; note = 2'-O-methyladenosine
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = cm
  modified_base 9: mod_base = cm
  modified_base 10: mod_base = cm
  modified_base 11: mod_base = OTHER; note = 2'-O-methyladenosine
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = cm
  modified_base 17: mod_base = um
  modified_base 18: mod_base = cm
  modified_base 19: mod_base = OTHER; note = 2'-O-methyladenosine
  modified_base 20: mod_base = um
  modified_base 20^21: mod_base = OTHER; note = phosphorodithioate linkage
  modified_base 21: mod_base = cm
  source 1..21: mol_type = other RNA
tagaaaacccaaatcctcatc

SEQ ID NO: 979 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 4: mod_base = gm
  modified_base 5: mod_base = um
  modified_base 6: mod_base = OTHER; note = 2'-O-methyladenosine
  modified_base 7: mod_base = cm
  modified_base 8: mod_base = um
  modified_base 9: mod_base = OTHER; note = 2'-fluorocytidine
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = cm
  modified_base 14: mod_base = OTHER; note = 2'-fluoroadenosine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = cm
  source 1..21: mol_type = other RNA
aaagtactcagacaccacagc

SEQ ID NO: 980 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 4: mod_base = gm
  modified_base 5: mod_base = OTHER; note = 2'-fluorouridine
  modified_base 6: mod_base = OTHER; note = 2'-O-methyladenosine
  modified_base 7: mod_base = cm
  modified_base 8: mod_base = um
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-O-methyladenosine
  modified_base 13: mod_base = cm
  modified_base 14: mod_base = OTHER; note = 2'-fluoroadenosine
  modified_base 15: mod_base = cm
  modified_base 16: mod_base = cm
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = cm
  source 1..21: mol_type = other RNA
aaagtactcagacaccacagc

SEQ ID NO: 981 - RNA, 21 nt, synthetic construct
  modified_base 1: mod_base = OTHER; note = 2'-deoxyadenosine
  modified_base 1^2: mod_base = OTHER; note = phosphorodithioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 4: mod_base = gm
  modified_base 5: mod_base = um
  modified_base 6: mod_base = OTHER; note = 2'-O-methyladenosine
  modified_base 7: mod_base = cm
  modified_base 8: mod_base = um
  modified_base 9: mod_base = OTHER; note = 2'-fluorocytidine
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = cm
  modified_base 14: mod_base = OTHER; note = 2'-fluoroadenosine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = cm
  source 1..21: mol_type = other RNA
aaagtactcagacaccacagc

SEQ ID NO: 982 - RNA, 21 nt, synthetic construct
  modified_base 1: mod_base = OTHER; note = 2'-deoxyadenosine
  modified_base 1^2: mod_base = OTHER; note = phosphorodithioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 4: mod_base = gm
  modified_base 5: mod_base = OTHER; note = 2'-fluorouridine
  modified_base 6: mod_base = OTHER; note = 2'-O-methyladenosine
  modified_base 7: mod_base = cm
  modified_base 8: mod_base = um
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-O-methyladenosine
  modified_base 13: mod_base = cm
  modified_base 14: mod_base = OTHER; note = 2'-fluoroadenosine
  modified_base 15: mod_base = cm
  modified_base 16: mod_base = cm
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = cm
  source 1..21: mol_type = other RNA
aaagtactcagacaccacagc

SEQ ID NO: 983 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 4: mod_base = gm
  modified_base 5: mod_base = um
  modified_base 6: mod_base = OTHER; note = 2'-O-methyladenosine
  modified_base 7: mod_base = OTHER; note = 2'-fluorocytidine
  modified_base 8: mod_base = um
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = cm
  modified_base 14: mod_base = OTHER; note = 2'-fluoroadenosine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = cm
  source 1..21: mol_type = other RNA
aaagtactcagacaccacagc

SEQ ID NO: 984 - RNA, 21 nt, synthetic construct
  modified_base 1: mod_base = OTHER; note = 2'-deoxyadenosine
  modified_base 1^2: mod_base = OTHER; note = phosphorodithioate linkage
  modified_base 2: mod_base = OTHER; note = 2'-fluoroadenosine
  modified_base 3: mod_base = OTHER; note = 2'-O-methyladenosine
  modified_base 4: mod_base = gm
  modified_base 5: mod_base = um
  modified_base 6: mod_base = OTHER; note = 2'-O-methyladenosine
  modified_base 7: mod_base = OTHER; note = 2'-fluorocytidine
  modified_base 8: mod_base = um
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = cm
  modified_base 14: mod_base = OTHER; note = 2'-fluoroadenosine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = cm
  source 1..21: mol_type = other RNA
aaagtactcagacaccacagc

SEQ ID NO: 985 - RNA, 21 nt, synthetic construct
  modified_base 1: mod_base = OTHER; note = 2'-deoxy-5-methyluridine
  modified_base 1^2: mod_base = OTHER; note = phosphorodithioate linkage
  modified_base 2: mod_base = OTHER; note = 2'-fluoroadenosine
  modified_base 3: mod_base = gm
  modified_base 4: mod_base = OTHER; note = 2'-O-methyladenosine
  modified_base 5: mod_base = OTHER; note = 2'-fluoroadenosine
  modified_base 6: mod_base = OTHER; note = 2'-O-methyladenosine
  modified_base 7: mod_base = OTHER; note = 2'-O-methyladenosine
  modified_base 8: mod_base = cm
  modified_base 9: mod_base = cm
  modified_base 10: mod_base = cm
  modified_base 11: mod_base = OTHER; note = 2'-O-methyladenosine
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluorocytidine
  modified_base 17: mod_base = um
  modified_base 18: mod_base = cm
  modified_base 19: mod_base = OTHER; note = 2'-O-methyladenosine
  modified_base 20: mod_base = um
  modified_base 20^21: mod_base = OTHER; note = phosphorothioate linkage
  modified_base 21: mod_base = cm
  source 1..21: mol_type = other RNA
tagaaaacccaaatcctcatc

SEQ ID NO: 986 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-O-methyladenosine
  modified_base 5: mod_base = OTHER; note = 2'-deoxyadenosine
  modified_base 6: mod_base = OTHER; note = 2'-O-methyladenosine
  modified_base 7: mod_base = OTHER; note = 2'-O-methyladenosine
  modified_base 8: mod_base = cm
  modified_base 9: mod_base = cm
  modified_base 10: mod_base = cm
  modified_base 11: mod_base = OTHER; note = 2'-O-methyladenosine
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluorocytidine
  modified_base 17: mod_base = um
  modified_base 18: mod_base = cm
  modified_base 19: mod_base = OTHER; note = 2'-O-methyladenosine
  modified_base 20: mod_base = um
  modified_base 20^21: mod_base = OTHER; note = phosphorothioate linkage
  modified_base 21: mod_base = cm
  source 1..21: mol_type = other RNA
tagaaaacccaaatcctcatc

SEQ ID NO: 987 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-O-methyladenosine
  modified_base 5: mod_base = OTHER; note = 2'-deoxyadenosine
  modified_base 6: mod_base = OTHER; note = 2'-O-methyladenosine
  modified_base 7: mod_base = OTHER; note = 2'-O-methyladenosine
  modified_base 8: mod_base = cm
  modified_base 9: mod_base = cm
  modified_base 10: mod_base = cm
  modified_base 11: mod_base = OTHER; note = 2'-O-methyladenosine
  modified_base 12: mod_base = OTHER; note = 2'-deoxyadenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluorocytidine
  modified_base 17: mod_base = um
  modified_base 18: mod_base = cm
  modified_base 19: mod_base = OTHER; note = 2'-O-methyladenosine
  modified_base 20: mod_base = um
  modified_base 20^21: mod_base = OTHER; note = phosphorothioate linkage
  modified_base 21: mod_base = cm
  source 1..21: mol_type = other RNA
tagaaaacccaaatcctcatc

SEQ ID NO: 988 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-O-methyladenosine
  modified_base 5: mod_base = OTHER; note = 2'-deoxyadenosine
  modified_base 6: mod_base = OTHER; note = 2'-O-methyladenosine
  modified_base 7: mod_base = OTHER; note = 2'-O-methyladenosine
  modified_base 8: mod_base = cm
  modified_base 9: mod_base = cm
  modified_base 10: mod_base = cm
  modified_base 11: mod_base = OTHER; note = 2'-O-methyladenosine
  modified_base 12: mod_base = OTHER; note = 2'-deoxyadenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-deoxycytidine
  modified_base 17: mod_base = um
  modified_base 18: mod_base = cm
  modified_base 19: mod_base = OTHER; note = 2'-O-methyladenosine
  modified_base 20: mod_base = um
  modified_base 20^21: mod_base = OTHER; note = phosphorothioate linkage
  modified_base 21: mod_base = cm
  source 1..21: mol_type = other RNA
tagaaaacccaaatcctcatc

SEQ ID NO: 989 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-deoxyadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-O-methyladenosine
  modified_base 5: mod_base = OTHER; note = 2'-deoxyadenosine
  modified_base 6: mod_base = OTHER; note = 2'-O-methyladenosine
  modified_base 7: mod_base = OTHER; note = 2'-O-methyladenosine
  modified_base 8: mod_base = cm
  modified_base 9: mod_base = cm
  modified_base 10: mod_base = cm
  modified_base 11: mod_base = OTHER; note = 2'-O-methyladenosine
  modified_base 12: mod_base = OTHER; note = 2'-deoxyadenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-deoxycytidine
  modified_base 17: mod_base = um
  modified_base 18: mod_base = cm
  modified_base 19: mod_base = OTHER; note = 2'-O-methyladenosine
  modified_base 20: mod_base = um
  modified_base 20^21: mod_base = OTHER; note = phosphorothioate linkage
  modified_base 21: mod_base = cm
  source 1..21: mol_type = other RNA
tagaaaacccaaatcctcatc

SEQ ID NO: 990 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-deoxyadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-O-methyladenosine
  modified_base 5: mod_base = OTHER; note = 2'-deoxyadenosine
  modified_base 6: mod_base = OTHER; note = 2'-O-methyladenosine
  modified_base 7: mod_base = OTHER; note = 2'-O-methyladenosine
  modified_base 8: mod_base = cm
  modified_base 9: mod_base = cm
  modified_base 10: mod_base = cm
  modified_base 11: mod_base = OTHER; note = 2'-O-methyladenosine
  modified_base 12: mod_base = OTHER; note = 2'-deoxyadenosine
  modified_base 13: mod_base = OTHER; note = 2'-O-methyladenosine
  modified_base 14: mod_base = OTHER; note = 2'-deoxy-5-methyluridine
  modified_base 15: mod_base = cm
  modified_base 16: mod_base = OTHER; note = 2'-deoxycytidine
  modified_base 17: mod_base = um
  modified_base 18: mod_base = cm
  modified_base 19: mod_base = OTHER; note = 2'-O-methyladenosine
  modified_base 20: mod_base = um
  modified_base 20^21: mod_base = OTHER; note = phosphorothioate linkage
  modified_base 21: mod_base = cm
  source 1..21: mol_type = other RNA
tagaaaacccaaatcctcatc

SEQ ID NO: 991 - RNA, 21 nt, synthetic construct
  modified_base 1: mod_base = OTHER; note = 2'-deoxy-5-methyluridine
  modified_base 1^2: mod_base = OTHER; note = phosphorodithioate linkage
  modified_base 2: mod_base = OTHER; note = 2'-deoxyadenosine
  modified_base 3: mod_base = gm
  modified_base 4: mod_base = OTHER; note = 2'-O-methyladenosine
  modified_base 5: mod_base = OTHER; note = 2'-deoxyadenosine
  modified_base 6: mod_base = OTHER; note = 2'-O-methyladenosine
  modified_base 7: mod_base = OTHER; note = 2'-O-methyladenosine
  modified_base 8: mod_base = cm
  modified_base 9: mod_base = cm
  modified_base 10: mod_base = cm
  modified_base 11: mod_base = OTHER; note = 2'-O-methyladenosine
  modified_base 12: mod_base = OTHER; note = 2'-deoxyadenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-deoxycytidine
  modified_base 17: mod_base = um
  modified_base 18: mod_base = cm
  modified_base 19: mod_base = OTHER; note = 2'-O-methyladenosine
  modified_base 20: mod_base = um
  modified_base 20^21: mod_base = OTHER; note = phosphorothioate linkage
  modified_base 21: mod_base = cm
  source 1..21: mol_type = other RNA
tagaaaacccaaatcctcatc

SEQ ID NO: 992 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-O-methyladenosine
  modified_base 5: mod_base = OTHER; note = 2'-fluoroadenosine
  modified_base 6: mod_base = OTHER; note = 2'-O-methyladenosine
  modified_base 7: mod_base = OTHER; note = 2'-O-methyladenosine
  modified_base 8: mod_base = cm
  modified_base 9: mod_base = cm
  modified_base 10: mod_base = cm
  modified_base 11: mod_base = OTHER; note = 2'-O-methyladenosine
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluorocytidine
  modified_base 17: mod_base = um
  modified_base 18: mod_base = cm
  modified_base 19: mod_base = OTHER; note = 2'-O-methyladenosine
  modified_base 20: mod_base = cm
  modified_base 20^21: mod_base = OTHER; note = phosphorothioate linkage
  modified_base 21: mod_base = cm
  source 1..21: mol_type = other RNA
tagaaaacccaaatcctcacc

SEQ ID NO: 993 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-O-methyladenosine
  modified_base 5: mod_base = OTHER; note = 2'-fluoroadenosine
  modified_base 6: mod_base = OTHER; note = 2'-O-methyladenosine
  modified_base 7: mod_base = OTHER; note = 2'-O-methyladenosine
  modified_base 8: mod_base = cm
  modified_base 9: mod_base = cm
  modified_base 10: mod_base = cm
  modified_base 11: mod_base = OTHER; note = 2'-O-methyladenosine
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluorocytidine
  modified_base 17: mod_base = um
  modified_base 18: mod_base = cm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = cm
  source 1..21: mol_type = other RNA
tagaaaacccaaatcctcagc

SEQ ID NO: 994 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 4: mod_base = gm
  modified_base 5: mod_base = um
  modified_base 6: mod_base = OTHER; note = 2'-O-methyladenosine
  modified_base 7: mod_base = OTHER; note = 2'-fluorocytidine
  modified_base 8: mod_base = um
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = cm
  modified_base 14: mod_base = OTHER; note = 2'-fluoroadenosine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = cm
  source 1..21: mol_type = other RNA
taagtactcagacaccacagc

SEQ ID NO: 995 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 4: mod_base = gm
  modified_base 5: mod_base = um
  modified_base 6: mod_base = OTHER; note = 2'-O-methyladenosine
  modified_base 7: mod_base = OTHER; note = 2'-deoxycytidine
  modified_base 8: mod_base = um
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = cm
  modified_base 14: mod_base = OTHER; note = 2'-fluoroadenosine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = cm
  source 1..21: mol_type = other RNA
aaagtactcagacaccacagc

SEQ ID NO: 996 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 4: mod_base = gm
  modified_base 5: mod_base = um
  modified_base 6: mod_base = OTHER; note = 2'-O-methyladenosine
  modified_base 7: mod_base = OTHER; note = 2'-deoxycytidine
  modified_base 8: mod_base = um
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-deoxyadenosine
  modified_base 13: mod_base = cm
  modified_base 14: mod_base = OTHER; note = 2'-fluoroadenosine
  modified_base 15: mod_base = cm
  modified_base 16: mod_base = OTHER; note = 2'-deoxycytidine
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = cm
  source 1..21: mol_type = other RNA
aaagtactcagacaccacagc

SEQ ID NO: 997 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-deoxyadenosine
  modified_base 2^3: mod_base = OTHER; note = phosphorothioate linkage
  modified_base 3: mod_base = OTHER; note = 2'-O-methyladenosine
  modified_base 4: mod_base = gm
  modified_base 5: mod_base = um
  modified_base 6: mod_base = OTHER; note = 2'-O-methyladenosine
  modified_base 7: mod_base = OTHER; note = 2'-deoxycytidine
  modified_base 8: mod_base = um
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-deoxyadenosine
  modified_base 13: mod_base = cm
  modified_base 14: mod_base = OTHER; note = 2'-fluoroadenosine
  modified_base 15: mod_base = cm
  modified_base 16: mod_base = OTHER; note = 2'-deoxycytidine
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = cm
  source 1..21: mol_type = other RNA
aaagtactcagacaccacagc

SEQ ID NO: 998 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-deoxyadenosine
  modified_base 2^3: mod_base = OTHER; note = phosphorothioate linkage
  modified_base 3: mod_base = OTHER; note = 2'-O-methyladenosine
  modified_base 4: mod_base = gm
  modified_base 5: mod_base = um
  modified_base 6: mod_base = OTHER; note = 2'-O-methyladenosine
  modified_base 7: mod_base = OTHER; note = 2'-deoxycytidine
  modified_base 8: mod_base = um
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-deoxyadenosine
  modified_base 13: mod_base = cm
  modified_base 14: mod_base = OTHER; note = 2'-deoxyadenosine
  modified_base 15: mod_base = cm
  modified_base 16: mod_base = OTHER; note = 2'-deoxycytidine
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = cm
  source 1..21: mol_type = other RNA
aaagtactcagacaccacagc

SEQ ID NO: 999 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-deoxyadenosine
  modified_base 2^3: mod_base = OTHER; note = phosphorothioate linkage
  modified_base 3: mod_base = OTHER; note = 2'-O-methyladenosine
  modified_base 4: mod_base = gm
  modified_base 5: mod_base = um
  modified_base 6: mod_base = OTHER; note = 2'-O-methyladenosine
  modified_base 7: mod_base = OTHER; note = 2'-fluorocytidine
  modified_base 8: mod_base = um
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = cm
  modified_base 14: mod_base = OTHER; note = 2'-deoxyadenosine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = cm
  source 1..21: mol_type = other RNA
aaagtactcagacaccacagc

SEQ ID NO: 1000 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 4: mod_base = gm
  modified_base 5: mod_base = um
  modified_base 6: mod_base = OTHER; note = 2'-O-methyladenosine
  modified_base 7: mod_base = OTHER; note = 2',3'-seco-cytidine
  modified_base 8: mod_base = um
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = cm
  modified_base 14: mod_base = OTHER; note = 2'-fluoroadenosine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = cm
  source 1..21: mol_type = other RNA
aaagtactcagacaccacagc

SEQ ID NO: 1001 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroguanosine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-fluoroadenosine
  modified_base 5: mod_base = OTHER; note = 2'-O-methyladenosine
  modified_base 6: mod_base = OTHER; note = 2'-fluoroadenosine
  modified_base 7: mod_base = cm
  modified_base 8: mod_base = OTHER; note = 2'-fluorocytidine
  modified_base 9: mod_base = cm
  modified_base 10: mod_base = OTHER; note = 2'-fluoroadenosine
  modified_base 11: mod_base = OTHER; note = 2'-O-methyladenosine
  modified_base 12: mod_base = OTHER; note = 2'-fluoroadenosine
  modified_base 13: mod_base = um
  modified_base 14: mod_base = OTHER; note = 2'-fluorocytidine
  modified_base 15: mod_base = cm
  modified_base 16: mod_base = OTHER; note = 2'-fluorouridine
  modified_base 17: mod_base = cm
  modified_base 18: mod_base = OTHER; note = 2'-fluoroadenosine
  modified_base 19: mod_base = um
  modified_base 20: mod_base = OTHER; note = 2'-fluorocytidine
  modified_base 20^21: mod_base = OTHER; note = phosphorothioate linkage
  modified_base 21: mod_base = um
  source 1..21: mol_type = other RNA
agaaaacccaaatcctcatct

SEQ ID NO: 1002 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-O-methyladenosine
  modified_base 5: mod_base = OTHER; note = 2'-fluoroadenosine
  modified_base 6: mod_base = OTHER; note = 2'-O-methyladenosine
  modified_base 7: mod_base = OTHER; note = 2'-O-methyladenosine
  modified_base 8: mod_base = cm
  modified_base 9: mod_base = cm
  modified_base 10: mod_base = cm
  modified_base 11: mod_base = OTHER; note = 2'-O-methyladenosine
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluorocytidine
  modified_base 17: mod_base = um
  modified_base 18: mod_base = cm
  modified_base 19: mod_base = OTHER; note = 2'-O-methyladenosine
  modified_base 20: mod_base = um
  modified_base 20^21: mod_base = OTHER; note = phosphorothioate linkage
  modified_base 21: mod_base = cm
  source 1..21: mol_type = other RNA
tagaaaacccaaatcctcatc

SEQ ID NO: 1003 - RNA, 21 nt, synthetic construct
  modified_base 1: mod_base = OTHER; note = 5'-cyclopropyl phosphonate-2'-O-methyladenosine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 4: mod_base = gm
  modified_base 5: mod_base = um
  modified_base 6: mod_base = OTHER; note = 2'-O-methyladenosine
  modified_base 7: mod_base = OTHER; note = 2'-fluorocytidine
  modified_base 8: mod_base = um
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = cm
  modified_base 14: mod_base = OTHER; note = 2'-fluoroadenosine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = cm
  source 1..21: mol_type = other RNA
aaagtactcagacaccacagc

SEQ ID NO: 1004 - RNA, 21 nt, synthetic construct
  modified_base 1: mod_base = OTHER; note = 2'-deoxy-5-methyluridine
  modified_base 1^2: mod_base = OTHER; note = phosphorodithioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-O-methyladenosine
  modified_base 5: mod_base = OTHER; note = 2'-fluoroadenosine
  modified_base 6: mod_base = OTHER; note = 2'-O-methyladenosine
  modified_base 7: mod_base = OTHER; note = 2'-O-methyladenosine
  modified_base 8: mod_base = cm
  modified_base 9: mod_base = cm
  modified_base 10: mod_base = cm
  modified_base 11: mod_base = OTHER; note = 2'-O-methyladenosine
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluorocytidine
  modified_base 17: mod_base = um
  modified_base 18: mod_base = cm
  modified_base 19: mod_base = OTHER; note = 2'-O-methyladenosine
  modified_base 20: mod_base = um
  modified_base 20^21: mod_base = OTHER; note = phosphorothioate linkage
  modified_base 21: mod_base = cm
  source 1..21: mol_type = other RNA
tagaaaacccaaatcctcatc

SEQ ID NO: 1005 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-deoxyadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-O-methyladenosine
  modified_base 5: mod_base = OTHER; note = 2'-deoxyadenosine
  modified_base 6: mod_base = OTHER; note = 2'-O-methyladenosine
  modified_base 7: mod_base = OTHER; note = 2'-deoxyadenosine
  modified_base 8: mod_base = cm
  modified_base 9: mod_base = cm
  modified_base 10: mod_base = cm
  modified_base 11: mod_base = OTHER; note = 2'-O-methyladenosine
  modified_base 12: mod_base = OTHER; note = 2'-deoxyadenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = cm
  modified_base 17: mod_base = um
  modified_base 18: mod_base = cm
  modified_base 19: mod_base = OTHER; note = 2'-O-methyladenosine
  modified_base 20: mod_base = um
  modified_base 20^21: mod_base = OTHER; note = phosphorothioate linkage
  modified_base 21: mod_base = cm
  source 1..21: mol_type = other RNA
tagaaaacccaaatcctcatc

SEQ ID NO: 1006 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-deoxyadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-O-methyladenosine
  modified_base 5: mod_base = OTHER; note = 2'-deoxyadenosine
  modified_base 6: mod_base = OTHER; note = 2'-O-methyladenosine
  modified_base 7: mod_base = OTHER; note = 2'-O-methyladenosine
  modified_base 8: mod_base = cm
  modified_base 9: mod_base = OTHER; note = 2'-deoxycytidine
  modified_base 10: mod_base = cm
  modified_base 11: mod_base = OTHER; note = 2'-O-methyladenosine
  modified_base 12: mod_base = OTHER; note = 2'-deoxyadenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = cm
  modified_base 17: mod_base = um
  modified_base 18: mod_base = cm
  modified_base 19: mod_base = OTHER; note = 2'-O-methyladenosine
  modified_base 20: mod_base = um
  modified_base 20^21: mod_base = OTHER; note = phosphorothioate linkage
  modified_base 21: mod_base = cm
  source 1..21: mol_type = other RNA
tagaaaacccaaatcctcatc

SEQ ID NO: 1007 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-deoxyadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-O-methyladenosine
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-deoxyadenosine
  modified_base 8: mod_base = cm
  modified_base 9: mod_base = OTHER; note = 2'-deoxycytidine
  modified_base 10: mod_base = cm
  modified_base 11: mod_base = OTHER; note = 2'-O-methyladenosine
  modified_base 12: mod_base = OTHER; note = 2'-deoxyadenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = cm
  modified_base 17: mod_base = um
  modified_base 18: mod_base = cm
  modified_base 19: mod_base = OTHER; note = 2'-O-methyladenosine
  modified_base 20: mod_base = um
  modified_base 20^21: mod_base = OTHER; note = phosphorothioate linkage
  modified_base 21: mod_base = cm
  source 1..21: mol_type = other RNA
tagaaaacccaaatcctcatc

SEQ ID NO: 1008 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-deoxyadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-O-methyladenosine
  modified_base 5: mod_base = OTHER; note = 2'-deoxyadenosine
  modified_base 6: mod_base = OTHER; note = 2'-O-methyladenosine
  modified_base 7: mod_base = OTHER; note = 2'-O-methyladenosine
  modified_base 8: mod_base = cm
  modified_base 9: mod_base = cm
  modified_base 10: mod_base = cm
  modified_base 11: mod_base = OTHER; note = 2'-O-methyladenosine
  modified_base 12: mod_base = OTHER; note = 2'-deoxyadenosine
  modified_base 13: mod_base = OTHER; note = 2'-O-methyladenosine
  modified_base 14: mod_base = OTHER; note = 2'-deoxy-5-methyluridine
  modified_base 15: mod_base = cm
  modified_base 16: mod_base = OTHER; note = 2'-deoxycytidine
  modified_base 17: mod_base = um
  modified_base 18: mod_base = cm
  modified_base 19: mod_base = OTHER; note = 2'-O-methyladenosine
  modified_base 20: mod_base = um
  modified_base 20^21: mod_base = OTHER; note = phosphorothioate linkage
  modified_base 21: mod_base = cm
  source 1..21: mol_type = other RNA
tagaaaacccaaatcctcatc

SEQ ID NO: 1009 - RNA, 19 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-O-methyladenosine
  modified_base 5: mod_base = OTHER; note = 2'-fluoroadenosine
  modified_base 6: mod_base = OTHER; note = 2'-O-methyladenosine
  modified_base 7: mod_base = OTHER; note = 2'-O-methyladenosine
  modified_base 8: mod_base = cm
  modified_base 9: mod_base = cm
  modified_base 10: mod_base = cm
  modified_base 11: mod_base = OTHER; note = 2'-O-methyladenosine
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluorocytidine
  modified_base 17: mod_base = um
  modified_base 18: mod_base = cm
  modified_base 18^19: mod_base = OTHER; note = phosphorothioate linkage
  modified_base 19: mod_base = OTHER; note = 2'-O-methyladenosine
  source 1..19: mol_type = other RNA
tagaaaacccaaatcctca

SEQ ID NO: 1010 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 4: mod_base = gm
  modified_base 5: mod_base = um
  modified_base 6: mod_base = OTHER; note = 2'-O-methyladenosine
  modified_base 7: mod_base = OTHER; note = 2'-fluorocytidine
  modified_base 8: mod_base = um
  modified_base 9: mod_base = um
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = cm
  modified_base 14: mod_base = OTHER; note = 2'-fluoroadenosine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = cm
  source 1..21: mol_type = other RNA
taagtacttagacaccacagc

SEQ ID NO: 1011 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 4: mod_base = gm
  modified_base 5: mod_base = um
  modified_base 6: mod_base = OTHER; note = 2'-O-methyladenosine
  modified_base 7: mod_base = OTHER; note = 2'-fluorocytidine
  modified_base 8: mod_base = um
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = um
  modified_base 14: mod_base = OTHER; note = 2'-fluoroadenosine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = cm
  source 1..21: mol_type = other RNA
taagtactcagataccacagc

SEQ ID NO: 1012 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 4: mod_base = gm
  modified_base 5: mod_base = um
  modified_base 6: mod_base = OTHER; note = 2'-O-methyladenosine
  modified_base 7: mod_base = OTHER; note = 2'-fluorocytidine
  modified_base 8: mod_base = um
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = cm
  modified_base 14: mod_base = OTHER; note = 2'-fluoroadenosine
  modified_base 15: mod_base = um
  modified_base 16: mod_base = OTHER; note = 2'-fluorocytidine
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = cm
  source 1..21: mol_type = other RNA
taagtactcagacatcacagc

SEQ ID NO: 1013 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 4: mod_base = gm
  modified_base 5: mod_base = um
  modified_base 6: mod_base = OTHER; note = 2'-O-methyladenosine
  modified_base 7: mod_base = OTHER; note = 2'-fluorocytidine
  modified_base 8: mod_base = um
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = cm
  modified_base 14: mod_base = OTHER; note = 2'-fluoroadenosine
  modified_base 15: mod_base = cm
  modified_base 16: mod_base = OTHER; note = 2'-fluorouridine
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = cm
  source 1..21: mol_type = other RNA
taagtactcagacactacagc

SEQ ID NO: 1014 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 4: mod_base = gm
  modified_base 5: mod_base = um
  modified_base 6: mod_base = OTHER; note = 2'-O-methyladenosine
  modified_base 7: mod_base = OTHER; note = 2'-fluorocytidine
  modified_base 8: mod_base = um
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = cm
  modified_base 14: mod_base = OTHER; note = 2'-fluoroadenosine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = um
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = cm
  source 1..21: mol_type = other RNA
taagtactcagacaccatagc

SEQ ID NO: 1015 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-O-methyladenosine
  modified_base 5: mod_base = OTHER; note = 2'-fluorouridine
  modified_base 6: mod_base = gm
  modified_base 7: mod_base = OTHER; note = 2'-O-methyladenosine
  modified_base 8: mod_base = cm
  modified_base 9: mod_base = OTHER; note = 2'-O-methyladenosine
  modified_base 10: mod_base = gm
  modified_base 11: mod_base = um
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = um
  modified_base 16: mod_base = OTHER; note = 2'-fluoroguanosine
  modified_base 17: mod_base = gm
  modified_base 18: mod_base = gm
  modified_base 19: mod_base = um
  modified_base 20: mod_base = cm
  modified_base 20^21: mod_base = OTHER; note = phosphorothioate linkage
  modified_base 21: mod_base = cm
  source 1..21: mol_type = other RNA
tcaatgacagtaattgggtcc

SEQ ID NO: 1016 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-O-methyladenosine
  modified_base 5: mod_base = um
  modified_base 6: mod_base = gm
  modified_base 7: mod_base = OTHER; note = 2'-fluoroadenosine
  modified_base 8: mod_base = cm
  modified_base 9: mod_base = OTHER; note = 2'-O-methyladenosine
  modified_base 10: mod_base = gm
  modified_base 11: mod_base = um
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = um
  modified_base 16: mod_base = OTHER; note = 2'-fluoroguanosine
  modified_base 17: mod_base = gm
  modified_base 18: mod_base = gm
  modified_base 19: mod_base = um
  modified_base 20: mod_base = cm
  modified_base 20^21: mod_base = OTHER; note = phosphorothioate linkage
  modified_base 21: mod_base = cm
  source 1..21: mol_type = other RNA
tcaatgacagtaattgggtcc

SEQ ID NO: 1017 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-O-methyladenosine
  modified_base 5: mod_base = um
  modified_base 6: mod_base = gm
  modified_base 7: mod_base = OTHER; note = 2'-O-methyladenosine
  modified_base 8: mod_base = cm
  modified_base 9: mod_base = OTHER; note = 2'-fluoroadenosine
  modified_base 10: mod_base = gm
  modified_base 11: mod_base = um
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = um
  modified_base 16: mod_base = OTHER; note = 2'-fluoroguanosine
  modified_base 17: mod_base = gm
  modified_base 18: mod_base = gm
  modified_base 19: mod_base = um
  modified_base 20: mod_base = cm
  modified_base 20^21: mod_base = OTHER; note = phosphorothioate linkage
  modified_base 21: mod_base = cm
  source 1..21: mol_type = other RNA
tcaatgacagtaattgggtcc

SEQ ID NO: 1018 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-O-methyladenosine
  modified_base 5: mod_base = um
  modified_base 6: mod_base = gm
  modified_base 7: mod_base = OTHER; note = 2'-O-methyladenosine
  modified_base 8: mod_base = OTHER; note = 2'-fluorocytidine
  modified_base 9: mod_base = OTHER; note = 2'-O-methyladenosine
  modified_base 10: mod_base = gm
  modified_base 11: mod_base = um
  modified_base 12: mod_base = OTHER; note = 2'-O-methyladenosine
  modified_base 13: mod_base = OTHER; note = 2'-O-methyladenosine
  modified_base 14: mod_base = OTHER; note = 2'-fluorouridine
  modified_base 15: mod_base = um
  modified_base 16: mod_base = gm
  modified_base 17: mod_base = gm
  modified_base 18: mod_base = gm
  modified_base 19: mod_base = um
  modified_base 20: mod_base = OTHER; note = 2'-fluorocytidine
  modified_base 20^21: mod_base = OTHER; note = phosphorothioate linkage
  modified_base 21: mod_base = cm
  source 1..21: mol_type = other RNA
tcaatgacagtaattgggtcc

SEQ ID NO: 1019 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-O-methyladenosine
  modified_base 5: mod_base = um
  modified_base 6: mod_base = gm
  modified_base 7: mod_base = OTHER; note = 2'-fluoroadenosine
  modified_base 8: mod_base = cm
  modified_base 9: mod_base = OTHER; note = 2'-O-methyladenosine
  modified_base 10: mod_base = gm
  modified_base 11: mod_base = um
  modified_base 12: mod_base = OTHER; note = 2'-O-methyladenosine
  modified_base 13: mod_base = OTHER; note = 2'-O-methyladenosine
  modified_base 14: mod_base = OTHER; note = 2'-fluorouridine
  modified_base 15: mod_base = um
  modified_base 16: mod_base = gm
  modified_base 17: mod_base = gm
  modified_base 18: mod_base = gm
  modified_base 19: mod_base = um
  modified_base 20: mod_base = cm
  modified_base 20^21: mod_base = OTHER; note = phosphorothioate linkage
  modified_base 21: mod_base = cm
  source 1..21: mol_type = other RNA
tcaatgacagtaattgggtcc

SEQ ID NO: 1020 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-O-methyladenosine
  modified_base 5: mod_base = um
  modified_base 6: mod_base = gm
  modified_base 7: mod_base = OTHER; note = 2'-O-methyladenosine
  modified_base 8: mod_base = cm
  modified_base 9: mod_base = OTHER; note = 2'-fluoroadenosine
  modified_base 10: mod_base = gm
  modified_base 11: mod_base = um
  modified_base 12: mod_base = OTHER; note = 2'-O-methyladenosine
  modified_base 13: mod_base = OTHER; note = 2'-O-methyladenosine
  modified_base 14: mod_base = OTHER; note = 2'-fluorouridine
  modified_base 15: mod_base = um
  modified_base 16: mod_base = gm
  modified_base 17: mod_base = gm
  modified_base 18: mod_base = gm
  modified_base 19: mod_base = um
  modified_base 20: mod_base = cm
  modified_base 20^21: mod_base = OTHER; note = phosphorothioate linkage
  modified_base 21: mod_base = cm
  source 1..21: mol_type = other RNA
tcaatgacagtaattgggtcc

SEQ ID NO: 1021 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-O-methyladenosine
  modified_base 5: mod_base = OTHER; note = 2'-fluorouridine
  modified_base 6: mod_base = gm
  modified_base 7: mod_base = OTHER; note = 2',3'-seco-adenosine
  modified_base 8: mod_base = cm
  modified_base 9: mod_base = OTHER; note = 2'-O-methyladenosine
  modified_base 10: mod_base = gm
  modified_base 11: mod_base = um
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = um
  modified_base 16: mod_base = OTHER; note = 2'-fluoroguanosine
  modified_base 17: mod_base = gm
  modified_base 18: mod_base = gm
  modified_base 19: mod_base = um
  modified_base 20: mod_base = cm
  modified_base 20^21: mod_base = OTHER; note = phosphorothioate linkage
  modified_base 21: mod_base = cm
  source 1..21: mol_type = other RNA
tcaatgacagtaattgggtcc

SEQ ID NO: 1022 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = OTHER; note = 2'-O-methyladenosine
  modified_base 4: mod_base = OTHER; note = 2'-O-methyladenosine
  modified_base 5: mod_base = um
  modified_base 6: mod_base = gm
  modified_base 7: mod_base = OTHER; note = 2'-fluoroadenosine
  modified_base 8: mod_base = cm
  modified_base 9: mod_base = OTHER; note = 2'-O-methyladenosine
  modified_base 10: mod_base = gm
  modified_base 11: mod_base = um
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = um
  modified_base 16: mod_base = OTHER; note = 2'-fluoroguanosine
  modified_base 17: mod_base = gm
  modified_base 18: mod_base = gm
  modified_base 19: mod_base = um
  modified_base 20: mod_base = cm
  modified_base 20^21: mod_base = OTHER; note = phosphorothioate linkage
  modified_base 21: mod_base = cm
  source 1..21: mol_type = other RNA
tcaatgacagtaattgggtcc

SEQ ID NO: 1023 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluorocytidine
  modified_base 2^3: mod_base = OTHER; note = phosphorothioate linkage
  modified_base 3: mod_base = OTHER; note = 2'-O-methyladenosine
  modified_base 4: mod_base = OTHER; note = 2'-O-methyladenosine
  modified_base 5: mod_base = um
  modified_base 6: mod_base = gm
  modified_base 7: mod_base = OTHER; note = 2'-fluoroadenosine
  modified_base 8: mod_base = cm
  modified_base 9: mod_base = OTHER; note = 2'-O-methyladenosine
  modified_base 10: mod_base = gm
  modified_base 11: mod_base = um
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = um
  modified_base 16: mod_base = OTHER; note = 2'-fluoroguanosine
  modified_base 17: mod_base = gm
  modified_base 18: mod_base = gm
  modified_base 19: mod_base = um
  modified_base 20: mod_base = cm
  modified_base 20^21: mod_base = OTHER; note = phosphorodithioate linkage
  modified_base 21: mod_base = cm
  source 1..21: mol_type = other RNA
tcaatgacagtaattgggtcc

SEQ ID NO: 1024 - RNA, 21 nt, synthetic construct
  modified_base 1: mod_base = OTHER; note = 2'-deoxy-5-methyluridine
  modified_base 1^2: mod_base = OTHER; note = phosphorodithioate linkage
  modified_base 2: mod_base = OTHER; note = 2'-fluorocytidine
  modified_base 2^3: mod_base = OTHER; note = phosphorothioate linkage
  modified_base 3: mod_base = OTHER; note = 2'-O-methyladenosine
  modified_base 3^4: mod_base = OTHER; note = phosphorothioate linkage
  modified_base 4: mod_base = OTHER; note = 2'-O-methyladenosine
  modified_base 5: mod_base = um
  modified_base 6: mod_base = gm
  modified_base 7: mod_base = OTHER; note = 2'-fluoroadenosine
  modified_base 8: mod_base = cm
  modified_base 9: mod_base = OTHER; note = 2'-O-methyladenosine
  modified_base 10: mod_base = gm
  modified_base 11: mod_base = um
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = um
  modified_base 16: mod_base = OTHER; note = 2'-fluoroguanosine
  modified_base 17: mod_base = gm
  modified_base 18: mod_base = gm
  modified_base 19: mod_base = um
  modified_base 20: mod_base = cm
  modified_base 20^21: mod_base = OTHER; note = phosphorothioate linkage
  modified_base 21: mod_base = cm
  source 1..21: mol_type = other RNA
tcaatgacagtaattgggtcc

SEQ ID NO: 1025 - RNA, 21 nt, synthetic construct
  modified_base 1: mod_base = OTHER; note = 2'-deoxy-5-methyluridine
  modified_base 1^2: mod_base = OTHER; note = phosphorodithioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 4: mod_base = OTHER; note = 2'-O-methyladenosine
  modified_base 5: mod_base = OTHER; note = 2'-fluoroadenosine
  modified_base 6: mod_base = OTHER; note = 2'-O-methyladenosine
  modified_base 7: mod_base = OTHER; note = 2'-O-methyladenosine
  modified_base 8: mod_base = cm
  modified_base 9: mod_base = cm
  modified_base 10: mod_base = cm
  modified_base 11: mod_base = OTHER; note = 2'-O-methyladenosine
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluorocytidine
  modified_base 17: mod_base = um
  modified_base 18: mod_base = cm
  modified_base 19: mod_base = OTHER; note = 2'-O-methyladenosine
  modified_base 20: mod_base = um
  modified_base 20^21: mod_base = OTHER; note = phosphorothioate linkage
  modified_base 21: mod_base = cm
  source 1..21: mol_type = other RNA
tagaaaacccaaatcctcatc

SEQ ID NO: 1026 - RNA, 21 nt, synthetic construct
  modified_base 1: mod_base = OTHER; note = 2'-deoxy-5-methyluridine
  modified_base 1^2: mod_base = OTHER; note = phosphorodithioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 4: mod_base = OTHER; note = 2'-O-methyladenosine
  modified_base 5: mod_base = OTHER; note = 2'-fluoroadenosine
  modified_base 6: mod_base = OTHER; note = 2'-O-methyladenosine
  modified_base 7: mod_base = OTHER; note = 2'-O-methyladenosine
  modified_base 8: mod_base = cm
  modified_base 9: mod_base = cm
  modified_base 10: mod_base = cm
  modified_base 11: mod_base = OTHER; note = 2'-O-methyladenosine
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluorocytidine
  modified_base 17: mod_base = um
  modified_base 18: mod_base = cm
  modified_base 19: mod_base = OTHER; note = 2'-O-methyladenosine
  modified_base 20: mod_base = um
  modified_base 20^21: mod_base = OTHER; note = phosphorodithioate linkage
  modified_base 21: mod_base = cm
  source 1..21: mol_type = other RNA
tagaaaacccaaatcctcatc

SEQ ID NO: 1027 - RNA, 21 nt, synthetic construct
  modified_base 1: mod_base = OTHER; note = 2'-fluorouridine
  modified_base 1^2: mod_base = OTHER; note = phosphorodithioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 4: mod_base = OTHER; note = 2'-O-methyladenosine
  modified_base 5: mod_base = OTHER; note = 2'-fluoroadenosine
  modified_base 6: mod_base = OTHER; note = 2'-O-methyladenosine
  modified_base 7: mod_base = OTHER; note = 2'-O-methyladenosine
  modified_base 8: mod_base = cm
  modified_base 9: mod_base = cm
  modified_base 10: mod_base = cm
  modified_base 11: mod_base = OTHER; note = 2'-O-methyladenosine
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluorocytidine
  modified_base 17: mod_base = um
  modified_base 18: mod_base = cm
  modified_base 19: mod_base = OTHER; note = 2'-O-methyladenosine
  modified_base 20: mod_base = um
  modified_base 20^21: mod_base = OTHER; note = phosphorothioate linkage
  modified_base 21: mod_base = cm
  source 1..21: mol_type = other RNA
tagaaaacccaaatcctcatc

SEQ ID NO: 1028 - RNA, 21 nt, synthetic construct
  modified_base 1: mod_base = OTHER; note = 2'-fluorouridine
  modified_base 1^2: mod_base = OTHER; note = phosphorodithioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 4: mod_base = OTHER; note = 2'-O-methyladenosine
  modified_base 5: mod_base = OTHER; note = 2'-fluoroadenosine
  modified_base 6: mod_base = OTHER; note = 2'-O-methyladenosine
  modified_base 7: mod_base = OTHER; note = 2'-O-methyladenosine
  modified_base 8: mod_base = cm
  modified_base 9: mod_base = cm
  modified_base 10: mod_base = cm
  modified_base 11: mod_base = OTHER; note = 2'-O-methyladenosine
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluorocytidine
  modified_base 17: mod_base = um
  modified_base 18: mod_base = cm
  modified_base 19: mod_base = OTHER; note = 2'-O-methyladenosine
  modified_base 20: mod_base = um
  modified_base 20^21: mod_base = OTHER; note = phosphorodithioate linkage
  modified_base 21: mod_base = cm
  source 1..21: mol_type = other RNA
tagaaaacccaaatcctcatc

SEQ ID NO: 1029 - RNA, 21 nt, synthetic construct
  modified_base 1: mod_base = OTHER; note = 2'-fluorouridine
  modified_base 1^2: mod_base = OTHER; note = phosphorodithioate linkage
  modified_base 2: mod_base = OTHER; note = 2'-fluoroadenosine
  modified_base 3: mod_base = gm
  modified_base 4: mod_base = OTHER; note = 2'-O-methyladenosine
  modified_base 5: mod_base = OTHER; note = 2'-fluoroadenosine
  modified_base 6: mod_base = OTHER; note = 2'-O-methyladenosine
  modified_base 7: mod_base = OTHER; note = 2'-O-methyladenosine
  modified_base 8: mod_base = cm
  modified_base 9: mod_base = cm
  modified_base 10: mod_base = cm
  modified_base 11: mod_base = OTHER; note = 2'-O-methyladenosine
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluorocytidine
  modified_base 17: mod_base = um
  modified_base 18: mod_base = cm
  modified_base 19: mod_base = OTHER; note = 2'-O-methyladenosine
  modified_base 20: mod_base = um
  modified_base 20^21: mod_base = OTHER; note = phosphorodithioate linkage
  modified_base 21: mod_base = cm
  source 1..21: mol_type = other RNA
tagaaaacccaaatcctcatc

SEQ ID NO: 1030 - RNA, 21 nt, synthetic construct
  modified_base 1: mod_base = OTHER; note = 2'-O-methylinosine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 3^4: mod_base = OTHER; note = phosphorothioate linkage
  modified_base 4: mod_base = OTHER; note = 2'-O-methyladenosine
  modified_base 5: mod_base = OTHER; note = 2'-fluoroadenosine
  modified_base 6: mod_base = OTHER; note = 2'-O-methyladenosine
  modified_base 7: mod_base = OTHER; note = 2'-O-methyladenosine
  modified_base 8: mod_base = cm
  modified_base 9: mod_base = cm
  modified_base 10: mod_base = cm
  modified_base 11: mod_base = OTHER; note = 2'-O-methyladenosine
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluorocytidine
  modified_base 17: mod_base = um
  modified_base 18: mod_base = cm
  modified_base 19: mod_base = OTHER; note = 2'-O-methyladenosine
  modified_base 20: mod_base = um
  modified_base 20^21: mod_base = OTHER; note = phosphorothioate linkage
  modified_base 21: mod_base = cm
  source 1..21: mol_type = other RNA
nagaaaacccaaatcctcatc

SEQ ID NO: 1031 - RNA, 19 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 4: mod_base = gm
  modified_base 5: mod_base = um
  modified_base 6: mod_base = OTHER; note = 2'-O-methyladenosine
  modified_base 7: mod_base = OTHER; note = 2'-fluorocytidine
  modified_base 8: mod_base = um
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = cm
  modified_base 14: mod_base = OTHER; note = 2'-fluoroadenosine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = cm
  modified_base 18^19: mod_base = OTHER; note = phosphorothioate linkage
  modified_base 19: mod_base = OTHER; note = 2'-O-methyladenosine
  source 1..19: mol_type = other RNA
aaagtactcagacaccaca

SEQ ID NO: 1032 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 4: mod_base = gm
  modified_base 5: mod_base = um
  modified_base 6: mod_base = OTHER; note = 2'-O-methyladenosine
  modified_base 7: mod_base = OTHER; note = 2'-fluorocytidine
  modified_base 8: mod_base = um
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = cm
  modified_base 14: mod_base = OTHER; note = 2'-fluoroadenosine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = cm
  modified_base 19: mod_base = OTHER; note = 2'-O-methyladenosine
  modified_base 19^20: mod_base = OTHER; note = phosphorothioate linkage
  modified_base 20: mod_base = gm
  modified_base 20^21: mod_base = OTHER; note = phosphorothioate linkage
  modified_base 21: mod_base = cm
  source 1..21: mol_type = other RNA
aaagtactcagacaccacagc

SEQ ID NO: 1033 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 4: mod_base = gm
  modified_base 5: mod_base = um
  modified_base 6: mod_base = OTHER; note = 2'-O-methyladenosine
  modified_base 7: mod_base = OTHER; note = 2'-fluorocytidine
  modified_base 8: mod_base = um
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = cm
  modified_base 14: mod_base = OTHER; note = 2'-fluoroadenosine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = cm
  modified_base 19: mod_base = gm
  modified_base 19^20: mod_base = OTHER; note = phosphorothioate linkage
  modified_base 20: mod_base = gm
  modified_base 20^21: mod_base = OTHER; note = phosphorothioate linkage
  modified_base 21: mod_base = cm
  source 1..21: mol_type = other RNA
aaagtactcagacaccacggc

SEQ ID NO: 1034 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 4: mod_base = gm
  modified_base 5: mod_base = um
  modified_base 6: mod_base = OTHER; note = 2'-O-methyladenosine
  modified_base 7: mod_base = OTHER; note = 2'-fluorocytidine
  modified_base 8: mod_base = um
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = cm
  modified_base 14: mod_base = OTHER; note = 2'-fluoroadenosine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = cm
  modified_base 19: mod_base = cm
  modified_base 19^20: mod_base = OTHER; note = phosphorothioate linkage
  modified_base 20: mod_base = gm
  modified_base 20^21: mod_base = OTHER; note = phosphorothioate linkage
  modified_base 21: mod_base = cm
  source 1..21: mol_type = other RNA
aaagtactcagacaccaccgc

SEQ ID NO: 1035 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 4: mod_base = gm
  modified_base 5: mod_base = um
  modified_base 6: mod_base = OTHER; note = 2'-O-methyladenosine
  modified_base 7: mod_base = OTHER; note = 2'-fluorocytidine
  modified_base 8: mod_base = um
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = cm
  modified_base 14: mod_base = OTHER; note = 2'-fluoroadenosine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = um
  modified_base 19: mod_base = OTHER; note = 2'-O-methyladenosine
  modified_base 20: mod_base = gm
  modified_base 20^21: mod_base = OTHER; note = phosphorodithioate linkage
  modified_base 21: mod_base = cm
  source 1..21: mol_type = other RNA
taagtactcagacaccatagc

SEQ ID NO: 1036 - RNA, 21 nt, synthetic construct
  modified_base 1: mod_base = um
  modified_base 1^2: mod_base = OTHER; note = phosphorodithioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 4: mod_base = gm
  modified_base 5: mod_base = um
  modified_base 6: mod_base = OTHER; note = 2'-O-methyladenosine
  modified_base 7: mod_base = OTHER; note = 2'-fluorocytidine
  modified_base 8: mod_base = um
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = cm
  modified_base 14: mod_base = OTHER; note = 2'-fluoroadenosine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = um
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = cm
  source 1..21: mol_type = other RNA
taagtactcagacaccatagc

SEQ ID NO: 1037 - RNA, 21 nt, synthetic construct
  modified_base 1: mod_base = um
  modified_base 1^2: mod_base = OTHER; note = phosphorodithioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 4: mod_base = gm
  modified_base 5: mod_base = um
  modified_base 6: mod_base = OTHER; note = 2'-O-methyladenosine
  modified_base 7: mod_base = OTHER; note = 2'-fluorocytidine
  modified_base 8: mod_base = um
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = cm
  modified_base 14: mod_base = OTHER; note = 2'-fluoroadenosine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = um
  modified_base 19: mod_base = OTHER; note = 2'-O-methyladenosine
  modified_base 20: mod_base = gm
  modified_base 20^21: mod_base = OTHER; note = phosphorodithioate linkage
  modified_base 21: mod_base = cm
  source 1..21: mol_type = other RNA
taagtactcagacaccatagc

SEQ ID NO: 1038 - RNA, 21 nt, synthetic construct
  modified_base 1: mod_base = OTHER; note = 2'-deoxy-5-methyluridine
  modified_base 1^2: mod_base = OTHER; note = phosphorodithioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 4: mod_base = gm
  modified_base 5: mod_base = um
  modified_base 6: mod_base = OTHER; note = 2'-O-methyladenosine
  modified_base 7: mod_base = OTHER; note = 2'-fluorocytidine
  modified_base 8: mod_base = um
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = cm
  modified_base 14: mod_base = OTHER; note = 2'-fluoroadenosine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = um
  modified_base 19: mod_base = OTHER; note = 2'-O-methyladenosine
  modified_base 20: mod_base = gm
  modified_base 20^21: mod_base = OTHER; note = phosphorodithioate linkage
  modified_base 21: mod_base = cm
  source 1..21: mol_type = other RNA
taagtactcagacaccatagc

SEQ ID NO: 1039 - RNA, 21 nt, synthetic construct
  modified_base 1: mod_base = OTHER; note = 5'-cyclopropyl phosphonate-2'-O-methyluridine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 4: mod_base = gm
  modified_base 5: mod_base = um
  modified_base 6: mod_base = OTHER; note = 2'-O-methyladenosine
  modified_base 7: mod_base = OTHER; note = 2'-fluorocytidine
  modified_base 8: mod_base = um
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = cm
  modified_base 14: mod_base = OTHER; note = 2'-fluoroadenosine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = um
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = cm
  source 1..21: mol_type = other RNA
taagtactcagacaccatagc

SEQ ID NO: 1040 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 4: mod_base = OTHER; note = 2'-O-methyladenosine
  modified_base 5: mod_base = OTHER; note = 2'-fluoroadenosine
  modified_base 6: mod_base = OTHER; note = 2'-O-methyladenosine
  modified_base 7: mod_base = OTHER; note = 2'-O-methyladenosine
  modified_base 8: mod_base = cm
  modified_base 9: mod_base = cm
  modified_base 10: mod_base = cm
  modified_base 11: mod_base = OTHER; note = 2'-O-methyladenosine
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluorocytidine
  modified_base 17: mod_base = um
  modified_base 18: mod_base = cm
  modified_base 19: mod_base = OTHER; note = 2'-O-methyladenosine
  modified_base 20: mod_base = um
  modified_base 20^21: mod_base = OTHER; note = phosphorothioate linkage
  modified_base 21: mod_base = cm
  source 1..21: mol_type = other RNA
tagaaaacccaaatcctcatc

SEQ ID NO: 1041 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 4: mod_base = OTHER; note = 2'-O-methyladenosine
  modified_base 5: mod_base = OTHER; note = 2'-fluoroadenosine
  modified_base 6: mod_base = OTHER; note = 2'-O-methyladenosine
  modified_base 7: mod_base = OTHER; note = 2'-O-methyladenosine
  modified_base 8: mod_base = cm
  modified_base 9: mod_base = cm
  modified_base 10: mod_base = cm
  modified_base 11: mod_base = OTHER; note = 2'-O-methyladenosine
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluorocytidine
  modified_base 17: mod_base = um
  modified_base 18: mod_base = cm
  modified_base 19: mod_base = OTHER; note = 2'-O-methyladenosine
  modified_base 20: mod_base = cm
  modified_base 20^21: mod_base = OTHER; note = phosphorothioate linkage
  modified_base 21: mod_base = cm
  source 1..21: mol_type = other RNA
tagaaaacccaaatcctcacc

SEQ ID NO: 1042 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 4: mod_base = OTHER; note = 2'-O-methyladenosine
  modified_base 5: mod_base = OTHER; note = 2'-deoxyadenosine
  modified_base 6: mod_base = OTHER; note = 2'-O-methyladenosine
  modified_base 7: mod_base = OTHER; note = 2'-O-methyladenosine
  modified_base 8: mod_base = cm
  modified_base 9: mod_base = cm
  modified_base 10: mod_base = cm
  modified_base 11: mod_base = OTHER; note = 2'-O-methyladenosine
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluorocytidine
  modified_base 17: mod_base = um
  modified_base 18: mod_base = cm
  modified_base 19: mod_base = OTHER; note = 2'-O-methyladenosine
  modified_base 20: mod_base = um
  modified_base 20^21: mod_base = OTHER; note = phosphorothioate linkage
  modified_base 21: mod_base = cm
  source 1..21: mol_type = other RNA
tagaaaacccaaatcctcatc

SEQ ID NO: 1043 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 4: mod_base = OTHER; note = 2'-O-methyladenosine
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-fluoroadenosine
  modified_base 8: mod_base = cm
  modified_base 9: mod_base = cm
  modified_base 10: mod_base = cm
  modified_base 11: mod_base = OTHER; note = 2'-O-methyladenosine
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluorocytidine
  modified_base 17: mod_base = um
  modified_base 18: mod_base = cm
  modified_base 19: mod_base = OTHER; note = 2'-O-methyladenosine
  modified_base 20: mod_base = um
  modified_base 20^21: mod_base = OTHER; note = phosphorothioate linkage
  modified_base 21: mod_base = cm
  source 1..21: mol_type = other RNA
tagaaaacccaaatcctcatc

SEQ ID NO: 1044 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 4: mod_base = OTHER; note = 2'-O-methyladenosine
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-fluoroadenosine
  modified_base 8: mod_base = cm
  modified_base 9: mod_base = cm
  modified_base 10: mod_base = cm
  modified_base 11: mod_base = OTHER; note = 2'-O-methyladenosine
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluorocytidine
  modified_base 17: mod_base = um
  modified_base 18: mod_base = cm
  modified_base 19: mod_base = OTHER; note = 2'-O-methyladenosine
  modified_base 20: mod_base = cm
  modified_base 20^21: mod_base = OTHER; note = phosphorothioate linkage
  modified_base 21: mod_base = cm
  source 1..21: mol_type = other RNA
tagaaaacccaaatcctcacc

SEQ ID NO: 1045 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 4: mod_base = OTHER; note = 2'-O-methyladenosine
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-deoxyadenosine
  modified_base 8: mod_base = cm
  modified_base 9: mod_base = cm
  modified_base 10: mod_base = cm
  modified_base 11: mod_base = OTHER; note = 2'-O-methyladenosine
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluorocytidine
  modified_base 17: mod_base = um
  modified_base 18: mod_base = cm
  modified_base 19: mod_base = OTHER; note = 2'-O-methyladenosine
  modified_base 20: mod_base = um
  modified_base 20^21: mod_base = OTHER; note = phosphorothioate linkage
  modified_base 21: mod_base = cm
  source 1..21: mol_type = other RNA
tagaaaacccaaatcctcatc

SEQ ID NO: 1046 - RNA, 21 nt, synthetic construct
  modified_base 1: mod_base = um
  modified_base 1^2: mod_base = OTHER; note = phosphorodithioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 4: mod_base = OTHER; note = 2'-O-methyladenosine
  modified_base 5: mod_base = OTHER; note = 2'-fluoroadenosine
  modified_base 6: mod_base = OTHER; note = 2'-O-methyladenosine
  modified_base 7: mod_base = OTHER; note = 2'-O-methyladenosine
  modified_base 8: mod_base = cm
  modified_base 9: mod_base = cm
  modified_base 10: mod_base = cm
  modified_base 11: mod_base = OTHER; note = 2'-O-methyladenosine
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluorocytidine
  modified_base 17: mod_base = um
  modified_base 18: mod_base = cm
  modified_base 19: mod_base = OTHER; note = 2'-O-methyladenosine
  modified_base 20: mod_base = um
  modified_base 20^21: mod_base = OTHER; note = phosphorothioate linkage
  modified_base 21: mod_base = cm
  source 1..21: mol_type = other RNA
tagaaaacccaaatcctcatc

SEQ ID NO: 1047 - RNA, 21 nt, synthetic construct
  modified_base 1: mod_base = um
  modified_base 1^2: mod_base = OTHER; note = phosphorodithioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 4: mod_base = OTHER; note = 2'-O-methyladenosine
  modified_base 5: mod_base = OTHER; note = 2'-fluoroadenosine
  modified_base 6: mod_base = OTHER; note = 2'-O-methyladenosine
  modified_base 7: mod_base = OTHER; note = 2'-O-methyladenosine
  modified_base 8: mod_base = cm
  modified_base 9: mod_base = cm
  modified_base 10: mod_base = cm
  modified_base 11: mod_base = OTHER; note = 2'-O-methyladenosine
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluorocytidine
  modified_base 17: mod_base = um
  modified_base 18: mod_base = cm
  modified_base 19: mod_base = OTHER; note = 2'-O-methyladenosine
  modified_base 20: mod_base = cm
  modified_base 20^21: mod_base = OTHER; note = phosphorothioate linkage
  modified_base 21: mod_base = cm
  source 1..21: mol_type = other RNA
tagaaaacccaaatcctcacc

SEQ ID NO: 1048 - RNA, 21 nt, synthetic construct
  modified_base 1: mod_base = um
  modified_base 1^2: mod_base = OTHER; note = phosphorodithioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 4: mod_base = OTHER; note = 2'-O-methyladenosine
  modified_base 5: mod_base = OTHER; note = 2'-deoxyadenosine
  modified_base 6: mod_base = OTHER; note = 2'-O-methyladenosine
  modified_base 7: mod_base = OTHER; note = 2'-O-methyladenosine
  modified_base 8: mod_base = cm
  modified_base 9: mod_base = cm
  modified_base 10: mod_base = cm
  modified_base 11: mod_base = OTHER; note = 2'-O-methyladenosine
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluorocytidine
  modified_base 17: mod_base = um
  modified_base 18: mod_base = cm
  modified_base 19: mod_base = OTHER; note = 2'-O-methyladenosine
  modified_base 20: mod_base = um
  modified_base 20^21: mod_base = OTHER; note = phosphorothioate linkage
  modified_base 21: mod_base = cm
  source 1..21: mol_type = other RNA
tagaaaacccaaatcctcatc

SEQ ID NO: 1049 - RNA, 21 nt, synthetic construct
  modified_base 1: mod_base = um
  modified_base 1^2: mod_base = OTHER; note = phosphorodithioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 4: mod_base = OTHER; note = 2'-O-methyladenosine
  modified_base 5: mod_base = OTHER; note = 2'-fluoroadenosine
  modified_base 6: mod_base = OTHER; note = 2'-O-methyladenosine
  modified_base 7: mod_base = OTHER; note = 2'-O-methyladenosine
  modified_base 8: mod_base = cm
  modified_base 9: mod_base = cm
  modified_base 10: mod_base = cm
  modified_base 11: mod_base = OTHER; note = 2'-O-methyladenosine
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluorocytidine
  modified_base 17: mod_base = um
  modified_base 18: mod_base = cm
  modified_base 19: mod_base = OTHER; note = 2'-O-methyladenosine
  modified_base 20: mod_base = um
  modified_base 20^21: mod_base = OTHER; note = phosphorodithioate linkage
  modified_base 21: mod_base = cm
  source 1..21: mol_type = other RNA
tagaaaacccaaatcctcatc

SEQ ID NO: 1050 - RNA, 21 nt, synthetic construct
  modified_base 1: mod_base = um
  modified_base 1^2: mod_base = OTHER; note = phosphorodithioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 4: mod_base = OTHER; note = 2'-O-methyladenosine
  modified_base 5: mod_base = OTHER; note = 2'-fluoroadenosine
  modified_base 6: mod_base = OTHER; note = 2'-O-methyladenosine
  modified_base 7: mod_base = OTHER; note = 2'-O-methyladenosine
  modified_base 8: mod_base = cm
  modified_base 9: mod_base = cm
  modified_base 10: mod_base = cm
  modified_base 11: mod_base = OTHER; note = 2'-O-methyladenosine
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluorocytidine
  modified_base 17: mod_base = um
  modified_base 18: mod_base = cm
  modified_base 19: mod_base = OTHER; note = 2'-O-methyladenosine
  modified_base 20: mod_base = cm
  modified_base 20^21: mod_base = OTHER; note = phosphorodithioate linkage
  modified_base 21: mod_base = cm
  source 1..21: mol_type = other RNA
tagaaaacccaaatcctcacc

SEQ ID NO: 1051 - RNA, 21 nt, synthetic construct
  modified_base 1: mod_base = um
  modified_base 1^2: mod_base = OTHER; note = phosphorodithioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 4: mod_base = OTHER; note = 2'-O-methyladenosine
  modified_base 5: mod_base = OTHER; note = 2'-deoxyadenosine
  modified_base 6: mod_base = OTHER; note = 2'-O-methyladenosine
  modified_base 7: mod_base = OTHER; note = 2'-O-methyladenosine
  modified_base 8: mod_base = cm
  modified_base 9: mod_base = cm
  modified_base 10: mod_base = cm
  modified_base 11: mod_base = OTHER; note = 2'-O-methyladenosine
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluorocytidine
  modified_base 17: mod_base = um
  modified_base 18: mod_base = cm
  modified_base 19: mod_base = OTHER; note = 2'-O-methyladenosine
  modified_base 20: mod_base = um
  modified_base 20^21: mod_base = OTHER; note = phosphorodithioate linkage
  modified_base 21: mod_base = cm
  source 1..21: mol_type = other RNA
tagaaaacccaaatcctcatc

SEQ ID NO: 1052 - RNA, 19 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 4: mod_base = gm
  modified_base 5: mod_base = um
  modified_base 6: mod_base = OTHER; note = 2'-O-methyladenosine
  modified_base 7: mod_base = OTHER; note = 2'-fluorocytidine
  modified_base 8: mod_base = um
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = cm
  modified_base 14: mod_base = OTHER; note = 2'-fluoroadenosine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = cm
  modified_base 18^19: mod_base = OTHER; note = phosphorothioate linkage
  modified_base 19: mod_base = cm
  source 1..19: mol_type = other RNA
aaagtactcagacaccacc

SEQ ID NO: 1053 - RNA, 19 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 4: mod_base = gm
  modified_base 5: mod_base = um
  modified_base 6: mod_base = OTHER; note = 2'-O-methyladenosine
  modified_base 7: mod_base = OTHER; note = 2'-fluorocytidine
  modified_base 8: mod_base = um
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = cm
  modified_base 14: mod_base = OTHER; note = 2'-fluoroadenosine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = cm
  modified_base 18^19: mod_base = OTHER; note = phosphorothioate linkage
  modified_base 19: mod_base = gm
  source 1..19: mol_type = other RNA
aaagtactcagacaccacg

SEQ ID NO: 1054 - RNA, 19 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 4: mod_base = gm
  modified_base 5: mod_base = um
  modified_base 6: mod_base = OTHER; note = 2'-O-methyladenosine
  modified_base 7: mod_base = OTHER; note = 2'-fluorocytidine
  modified_base 8: mod_base = um
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = cm
  modified_base 14: mod_base = OTHER; note = 2'-fluoroadenosine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = cm
  modified_base 18^19: mod_base = OTHER; note = phosphorothioate linkage
  modified_base 19: mod_base = OTHER; note = 2'-O-methyl-2-aminoadenosine
  source 1..19: mol_type = other RNA
aaagtactcagacaccacn

SEQ ID NO: 1055 - RNA, 20 nt, synthetic construct
  modified_base 1: mod_base = OTHER; note = 5'-cyclopropyl phosphonate-2'-O-methyladenosine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 4: mod_base = gm
  modified_base 5: mod_base = um
  modified_base 6: mod_base = OTHER; note = 2'-O-methyladenosine
  modified_base 7: mod_base = OTHER; note = 2'-fluorocytidine
  modified_base 8: mod_base = um
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = cm
  modified_base 14: mod_base = OTHER; note = 2'-fluoroadenosine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = cm
  modified_base 18^19: mod_base = OTHER; note = phosphorothioate linkage
  modified_base 19: mod_base = cm
  source 1..20: mol_type = other RNA
caaagtactcagacaccacc

SEQ ID NO: 1056 - RNA, 19 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 4: mod_base = gm
  modified_base 5: mod_base = um
  modified_base 6: mod_base = OTHER; note = 2'-O-methyladenosine
  modified_base 7: mod_base = OTHER; note = 2'-fluorocytidine
  modified_base 8: mod_base = um
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = cm
  modified_base 14: mod_base = OTHER; note = 2'-fluoroadenosine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = cm
  modified_base 18^19: mod_base = OTHER; note = phosphorothioate linkage
  modified_base 19: mod_base = cm
  source 1..19: mol_type = other RNA
taagtactcagacaccacc

SEQ ID NO: 1057 - RNA, 19 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 4: mod_base = gm
  modified_base 5: mod_base = um
  modified_base 6: mod_base = OTHER; note = 2'-O-methyladenosine
  modified_base 7: mod_base = OTHER; note = 2'-fluorocytidine
  modified_base 8: mod_base = um
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = cm
  modified_base 14: mod_base = OTHER; note = 2'-fluoroadenosine
  modified_base 15: mod_base = cm
  modified_base 16: mod_base = OTHER; note = 2'-fluorocytidine
  modified_base 17: mod_base = OTHER; note = 2'-O-methyladenosine
  modified_base 17^18: mod_base = OTHER; note = phosphorothioate linkage
  modified_base 18: mod_base = cm
  modified_base 18^19: mod_base = OTHER; note = phosphorothioate linkage
  modified_base 19: mod_base = cm
  source 1..19: mol_type = other RNA
aaagtactcagacaccacc

SEQ ID NO: 1058 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 4: mod_base = gm
  modified_base 5: mod_base = um
  modified_base 6: mod_base = OTHER; note = 2'-O-methyladenosine
  modified_base 7: mod_base = OTHER; note = 2'-fluorocytidine
  modified_base 8: mod_base = um
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = cm
  modified_base 14: mod_base = OTHER; note = 2'-fluoroadenosine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = cm
  modified_base 19: mod_base = cm
  modified_base 19^20: mod_base = OTHER; note = phosphorothioate linkage
  modified_base 20: mod_base = gm
  modified_base 20^21: mod_base = OTHER; note = phosphorodithioate linkage
  modified_base 21: mod_base = cm
  source 1..21: mol_type = other RNA
aaagtactcagacaccaccgc

SEQ ID NO: 1059 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 4: mod_base = gm
  modified_base 5: mod_base = um
  modified_base 6: mod_base = OTHER; note = 2'-O-methyladenosine
  modified_base 7: mod_base = OTHER; note = 2'-fluorocytidine
  modified_base 8: mod_base = um
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = cm
  modified_base 14: mod_base = OTHER; note = 2'-fluoroadenosine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = cm
  modified_base 19: mod_base = cm
  modified_base 20: mod_base = gm
  modified_base 20^21: mod_base = OTHER; note = phosphorodithioate linkage
  modified_base 21: mod_base = cm
  source 1..21: mol_type = other RNA
aaagtactcagacaccaccgc

SEQ ID NO: 1060 - RNA, 19 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 4: mod_base = OTHER; note = 2'-O-methyladenosine
  modified_base 5: mod_base = OTHER; note = 2'-fluoroadenosine
  modified_base 6: mod_base = OTHER; note = 2'-O-methyladenosine
  modified_base 7: mod_base = OTHER; note = 2'-O-methyladenosine
  modified_base 8: mod_base = cm
  modified_base 9: mod_base = cm
  modified_base 10: mod_base = cm
  modified_base 11: mod_base = OTHER; note = 2'-O-methyladenosine
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluorocytidine
  modified_base 17: mod_base = um
  modified_base 17^18: mod_base = OTHER; note = phosphorothioate linkage
  modified_base 18: mod_base = cm
  modified_base 18^19: mod_base = OTHER; note = phosphorothioate linkage
  modified_base 19: mod_base = OTHER; note = 2'-O-methyladenosine
  source 1..19: mol_type = other RNA
tagaaaacccaaatcctca

SEQ ID NO: 1061 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 4: mod_base = OTHER; note = 2'-O-methyladenosine
  modified_base 5: mod_base = OTHER; note = 2'-fluoroadenosine
  modified_base 6: mod_base = OTHER; note = 2'-O-methyladenosine
  modified_base 7: mod_base = OTHER; note = 2'-O-methyladenosine
  modified_base 8: mod_base = cm
  modified_base 9: mod_base = cm
  modified_base 10: mod_base = cm
  modified_base 11: mod_base = OTHER; note = 2'-O-methyladenosine
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluorocytidine
  modified_base 17: mod_base = um
  modified_base 18: mod_base = cm
  modified_base 19: mod_base = OTHER; note = 2'-O-methyladenosine
  modified_base 19^20: mod_base = OTHER; note = phosphorothioate linkage
  modified_base 20: mod_base = um
  modified_base 20^21: mod_base = OTHER; note = phosphorothioate linkage
  modified_base 21: mod_base = cm
  source 1..21: mol_type = other RNA
tagaaaacccaaatcctcatc

SEQ ID NO: 1062 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 4: mod_base = OTHER; note = 2'-O-methyladenosine
  modified_base 5: mod_base = OTHER; note = 2'-fluoroadenosine
  modified_base 6: mod_base = OTHER; note = 2'-O-methyladenosine
  modified_base 7: mod_base = OTHER; note = 2'-O-methyladenosine
  modified_base 8: mod_base = cm
  modified_base 9: mod_base = cm
  modified_base 10: mod_base = cm
  modified_base 11: mod_base = OTHER; note = 2'-O-methyladenosine
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluorocytidine
  modified_base 17: mod_base = um
  modified_base 18: mod_base = cm
  modified_base 19: mod_base = cm
  modified_base 19^20: mod_base = OTHER; note = phosphorothioate linkage
  modified_base 20: mod_base = um
  modified_base 20^21: mod_base = OTHER; note = phosphorothioate linkage
  modified_base 21: mod_base = cm
  source 1..21: mol_type = other RNA
tagaaaacccaaatcctcctc

SEQ ID NO: 1063 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = gm
  modified_base 4: mod_base = OTHER; note = 2'-O-methyladenosine
  modified_base 5: mod_base = OTHER; note = 2'-fluoroadenosine
  modified_base 6: mod_base = OTHER; note = 2'-O-methyladenosine
  modified_base 7: mod_base = OTHER; note = 2'-O-methyladenosine
  modified_base 8: mod_base = cm
  modified_base 9: mod_base = cm
  modified_base 10: mod_base = cm
  modified_base 11: mod_base = OTHER; note = 2'-O-methyladenosine
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluorocytidine
  modified_base 17: mod_base = um
  modified_base 18: mod_base = cm
  modified_base 19: mod_base = gm
  modified_base 19^20: mod_base = OTHER; note = phosphorothioate linkage
  modified_base 20: mod_base = um
  modified_base 20^21: mod_base = OTHER; note = phosphorothioate linkage
  modified_base 21: mod_base = cm
  source 1..21: mol_type = other RNA
tagaaaacccaaatcctcgtc

SEQ ID NO: 1064 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 4: mod_base = gm
  modified_base 5: mod_base = um
  modified_base 6: mod_base = OTHER; note = 2'-O-methyladenosine
  modified_base 7: mod_base = OTHER; note = 2'-fluorocytidine
  modified_base 8: mod_base = um
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = cm
  modified_base 14: mod_base = OTHER; note = 2'-fluoroadenosine
  modified_base 15: mod_base = cm
  modified_base 16: mod_base = OTHER; note = 2'-deoxy-5-methyluridine
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = cm
  source 1..21: mol_type = other RNA
taagtactcagacactacagc

SEQ ID NO: 1065 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 4: mod_base = gm
  modified_base 5: mod_base = um
  modified_base 6: mod_base = OTHER; note = 2'-O-methyladenosine
  modified_base 7: mod_base = OTHER; note = 2'-fluorocytidine
  modified_base 8: mod_base = um
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = cm
  modified_base 14: mod_base = OTHER; note = 2'-fluoroadenosine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = OTHER; note = 2'-deoxy-5-methyluridine
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = cm
  source 1..21: mol_type = other RNA
taagtactcagacaccatagc

SEQ ID NO: 1066 - RNA, 21 nt, synthetic construct
  modified_base 1: mod_base = OTHER; note = 2'-O-methylinosine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 4: mod_base = gm
  modified_base 5: mod_base = um
  modified_base 6: mod_base = OTHER; note = 2'-O-methyladenosine
  modified_base 7: mod_base = OTHER; note = 2'-fluorocytidine
  modified_base 8: mod_base = um
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = cm
  modified_base 14: mod_base = OTHER; note = 2'-fluoroadenosine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = cm
  source 1..21: mol_type = other RNA
naagtactcagacaccacagc

SEQ ID NO: 1067 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 4: mod_base = gm
  modified_base 5: mod_base = um
  modified_base 6: mod_base = OTHER; note = 2'-O-methyladenosine
  modified_base 7: mod_base = OTHER; note = 2'-fluorocytidine
  modified_base 8: mod_base = um
  modified_base 9: mod_base = cm
  modified_base 10: mod_base = OTHER; note = 2'-O-methyladenosine
  modified_base 11: mod_base = cm
  modified_base 12: mod_base = OTHER; note = 2'-fluoroadenosine
  modified_base 13: mod_base = cm
  modified_base 14: mod_base = OTHER; note = 2'-fluoroadenosine
  modified_base 15: mod_base = cm
  modified_base 16: mod_base = OTHER; note = 2'-fluorouridine
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = cm
  source 1..21: mol_type = other RNA
taagtactcacacactacagc

SEQ ID NO: 1068 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 4: mod_base = gm
  modified_base 5: mod_base = um
  modified_base 6: mod_base = cm
  modified_base 7: mod_base = OTHER; note = 2'-fluorocytidine
  modified_base 8: mod_base = um
  modified_base 9: mod_base = cm
  modified_base 10: mod_base = OTHER; note = 2'-O-methyladenosine
  modified_base 11: mod_base = cm
  modified_base 12: mod_base = OTHER; note = 2'-fluoroadenosine
  modified_base 13: mod_base = cm
  modified_base 14: mod_base = OTHER; note = 2'-fluoroadenosine
  modified_base 15: mod_base = cm
  modified_base 16: mod_base = OTHER; note = 2'-fluoroadenosine
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = cm
  source 1..21: mol_type = other RNA
taagtcctcacacacaacagc

SEQ ID NO: 1069 - RNA, 21 nt, synthetic construct
  modified_base 1: mod_base = gm
  modified_base 2: mod_base = cm
  modified_base 3: mod_base = OTHER; note = 2'-O-methyladenosine
  modified_base 4: mod_base = um
  modified_base 5: mod_base = cm
  modified_base 6: mod_base = um
  modified_base 7: mod_base = OTHER; note = 2'-O-methyladenosine
  modified_base 8: mod_base = cm
  modified_base 9: mod_base = OTHER; note = 2'-fluorocytidine
  modified_base 10: mod_base = OTHER; note = 2'-fluorouridine
  modified_base 11: mod_base = OTHER; note = 2'-fluoroguanosine
  modified_base 12: mod_base = gm
  modified_base 13: mod_base = um
  modified_base 14: mod_base = gm
  modified_base 15: mod_base = cm
  modified_base 16: mod_base = um
  modified_base 17: mod_base = OTHER; note = 2'-O-methyladenosine
  modified_base 18: mod_base = gm
  modified_base 19: mod_base = OTHER; note = 2'-O-methyladenosine
  modified_base 20: mod_base = um
  modified_base 21: mod_base = OTHER; note = 2'-O-methyladenosine
  source 1..21: mol_type = other RNA
gcatctacctggtgctagata

SEQ ID NO: 1070 - RNA, 21 nt, synthetic construct
  modified_base 1: mod_base = cm
  modified_base 2: mod_base = OTHER; note = 2'-O-methyladenosine
  modified_base 3: mod_base = um
  modified_base 4: mod_base = cm
  modified_base 5: mod_base = um
  modified_base 6: mod_base = OTHER; note = 2'-O-methyladenosine
  modified_base 7: mod_base = cm
  modified_base 8: mod_base = cm
  modified_base 9: mod_base = OTHER; note = 2'-fluorouridine
  modified_base 10: mod_base = OTHER; note = 2'-fluoroguanosine
  modified_base 11: mod_base = OTHER; note = 2'-fluoroguanosine
  modified_base 12: mod_base = um
  modified_base 13: mod_base = gm
  modified_base 14: mod_base = cm
  modified_base 15: mod_base = um
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = um
  modified_base 20: mod_base = gm
  modified_base 21: mod_base = OTHER; note = 2'-O-methyladenosine
  source 1..21: mol_type = other RNA
catctacctggtgctagatga

SEQ ID NO: 1071 - RNA, 21 nt, synthetic construct
  modified_base 1: mod_base = OTHER; note = 2'-O-methyladenosine
  modified_base 2: mod_base = um
  modified_base 3: mod_base = cm
  modified_base 4: mod_base = um
  modified_base 5: mod_base = OTHER; note = 2'-O-methyladenosine
  modified_base 6: mod_base = cm
  modified_base 7: mod_base = cm
  modified_base 8: mod_base = um
  modified_base 9: mod_base = OTHER; note = 2'-fluoroguanosine
  modified_base 10: mod_base = OTHER; note = 2'-fluoroguanosine
  modified_base 11: mod_base = OTHER; note = 2'-fluorouridine
  modified_base 12: mod_base = gm
  modified_base 13: mod_base = cm
  modified_base 14: mod_base = um
  modified_base 15: mod_base = OTHER; note = 2'-O-methyladenosine
  modified_base 16: mod_base = gm
  modified_base 17: mod_base = OTHER; note = 2'-O-methyladenosine
  modified_base 18: mod_base = um
  modified_base 19: mod_base = OTHER; note = 2'-O-methylinosine
  modified_base 20: mod_base = gm
  modified_base 21: mod_base = OTHER; note = 2'-O-methyladenosine
  source 1..21: mol_type = other RNA
atctacctggtgctagatnga

SEQ ID NO: 1072 - RNA, 21 nt, synthetic construct
  modified_base 1: mod_base = um
  modified_base 2: mod_base = cm
  modified_base 3: mod_base = um
  modified_base 4: mod_base = OTHER; note = 2'-O-methyladenosine
  modified_base 5: mod_base = cm
  modified_base 6: mod_base = cm
  modified_base 7: mod_base = um
  modified_base 8: mod_base = gm
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluoroguanosine
  modified_base 12: mod_base = cm
  modified_base 13: mod_base = um
  modified_base 14: mod_base = OTHER; note = 2'-O-methyladenosine
  modified_base 15: mod_base = gm
  modified_base 16: mod_base = OTHER; note = 2'-O-methyladenosine
  modified_base 17: mod_base = um
  modified_base 18: mod_base = OTHER; note = 2'-O-methylinosine
  modified_base 19: mod_base = gm
  modified_base 20: mod_base = OTHER; note = 2'-O-methyladenosine
  modified_base 21: mod_base = um
  source 1..21: mol_type = other RNA
tctacctggtgctagatngat

SEQ ID NO: 1073 - RNA, 21 nt, synthetic construct
  modified_base 1: mod_base = um
  modified_base 2: mod_base = OTHER; note = 2'-O-methyladenosine
  modified_base 3: mod_base = cm
  modified_base 4: mod_base = cm
  modified_base 5: mod_base = um
  modified_base 6: mod_base = gm
  modified_base 7: mod_base = gm
  modified_base 8: mod_base = um
  modified_base 9: mod_base = OTHER; note = 2'-fluoroguanosine
  modified_base 10: mod_base = OTHER; note = 2'-fluorocytidine
  modified_base 11: mod_base = OTHER; note = 2'-fluorouridine
  modified_base 12: mod_base = OTHER; note = 2'-O-methyladenosine
  modified_base 13: mod_base = gm
  modified_base 14: mod_base = OTHER; note = 2'-O-methyladenosine
  modified_base 15: mod_base = um
  modified_base 16: mod_base = gm
  modified_base 17: mod_base = OTHER; note = 2'-O-methylinosine
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
tacctggtgctagatgnatca

SEQ ID NO: 1074 - RNA, 21 nt, synthetic construct
  modified_base 1: mod_base = um
  modified_base 2: mod_base = gm
  modified_base 3: mod_base = gm
  modified_base 4: mod_base = um
  modified_base 5: mod_base = gm
  modified_base 6: mod_base = cm
  modified_base 7: mod_base = um
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluorouridine
  modified_base 12: mod_base = gm
  modified_base 13: mod_base = gm
  modified_base 14: mod_base = OTHER; note = 2'-O-methyladenosine
  modified_base 15: mod_base = um
  modified_base 16: mod_base = cm
  modified_base 17: mod_base = OTHER; note = 2'-O-methyladenosine
  modified_base 18: mod_base = OTHER; note = 2'-O-methylinosine
  modified_base 19: mod_base = OTHER; note = 2'-O-methyladenosine
  modified_base 20: mod_base = cm
  modified_base 21: mod_base = OTHER; note = 2'-O-methyladenosine
  source 1..21: mol_type = other RNA
tggtgctagatggatcanaca

SEQ ID NO: 1075 - RNA, 21 nt, synthetic construct
  modified_base 1: mod_base = gm
  modified_base 2: mod_base = cm
  modified_base 3: mod_base = um
  modified_base 4: mod_base = OTHER; note = 2'-O-methyladenosine
  modified_base 5: mod_base = gm
  modified_base 6: mod_base = OTHER; note = 2'-O-methyladenosine
  modified_base 7: mod_base = um
  modified_base 8: mod_base = gm
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluorouridine
  modified_base 12: mod_base = cm
  modified_base 13: mod_base = OTHER; note = 2'-O-methyladenosine
  modified_base 14: mod_base = gm
  modified_base 15: mod_base = OTHER; note = 2'-O-methyladenosine
  modified_base 16: mod_base = cm
  modified_base 17: mod_base = OTHER; note = 2'-O-methyladenosine
  modified_base 18: mod_base = OTHER; note = 2'-O-methylinosine
  modified_base 19: mod_base = cm
  modified_base 20: mod_base = OTHER; note = 2'-O-methyladenosine
  modified_base 21: mod_base = um
  source 1..21: mol_type = other RNA
gctagatggatcagacancat

SEQ ID NO: 1076 - RNA, 21 nt, synthetic construct
  modified_base 1: mod_base = um
  modified_base 2: mod_base = cm
  modified_base 3: mod_base = um
  modified_base 4: mod_base = cm
  modified_base 5: mod_base = um
  modified_base 6: mod_base = gm
  modified_base 7: mod_base = OTHER; note = 2'-O-methyladenosine
  modified_base 8: mod_base = gm
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorouridine
  modified_base 12: mod_base = cm
  modified_base 13: mod_base = um
  modified_base 14: mod_base = gm
  modified_base 15: mod_base = um
  modified_base 16: mod_base = gm
  modified_base 17: mod_base = OTHER; note = 2'-O-methylinosine
  modified_base 18: mod_base = cm
  modified_base 19: mod_base = OTHER; note = 2'-O-methyladenosine
  modified_base 20: mod_base = um
  modified_base 21: mod_base = OTHER; note = 2'-O-methyladenosine
  source 1..21: mol_type = other RNA
tctctgagtctctgtgncata

SEQ ID NO: 1077 - RNA, 21 nt, synthetic construct
  modified_base 1: mod_base = gm
  modified_base 2: mod_base = cm
  modified_base 3: mod_base = um
  modified_base 4: mod_base = gm
  modified_base 5: mod_base = um
  modified_base 6: mod_base = gm
  modified_base 7: mod_base = gm
  modified_base 8: mod_base = um
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = OTHER; note = 2'-O-methyladenosine
  modified_base 15: mod_base = gm
  modified_base 16: mod_base = um
  modified_base 17: mod_base = OTHER; note = 2'-O-methyladenosine
  modified_base 18: mod_base = cm
  modified_base 19: mod_base = um
  modified_base 20: mod_base = um
  modified_base 21: mod_base = um
  source 1..21: mol_type = other RNA
gctgtggtgtctgagtacttt

SEQ ID NO: 1078 - RNA, 21 nt, synthetic construct
  modified_base 1: mod_base = cm
  modified_base 2: mod_base = gm
  modified_base 3: mod_base = um
  modified_base 4: mod_base = um
  modified_base 5: mod_base = um
  modified_base 6: mod_base = cm
  modified_base 7: mod_base = OTHER; note = 2'-O-methyladenosine
  modified_base 8: mod_base = um
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluoroadenosine
  modified_base 12: mod_base = OTHER; note = 2'-O-methyladenosine
  modified_base 13: mod_base = gm
  modified_base 14: mod_base = um
  modified_base 15: mod_base = um
  modified_base 16: mod_base = gm
  modified_base 17: mod_base = OTHER; note = 2'-O-methylinosine
  modified_base 18: mod_base = um
  modified_base 19: mod_base = gm
  modified_base 20: mod_base = um
  modified_base 21: mod_base = OTHER; note = 2'-O-methyladenosine
  source 1..21: mol_type = other RNA
cgtttcattcaagttgntgta

SEQ ID NO: 1079 - RNA, 21 nt, synthetic construct
  modified_base 1: mod_base = gm
  modified_base 2: mod_base = um
  modified_base 3: mod_base = OTHER; note = 2'-O-methyl-2-aminoadenosine
  modified_base 4: mod_base = OTHER; note = 2'-O-methyladenosine
  modified_base 5: mod_base = um
  modified_base 6: mod_base = cm
  modified_base 7: mod_base = OTHER; note = 2'-O-methyladenosine
  modified_base 8: mod_base = gm
  modified_base 9: mod_base = OTHER; note = 2'-fluorocytidine
  modified_base 10: mod_base = OTHER; note = 2'-fluorouridine
  modified_base 11: mod_base = OTHER; note = 2'-fluoroguanosine
  modified_base 12: mod_base = gm
  modified_base 13: mod_base = gm
  modified_base 14: mod_base = gm
  modified_base 15: mod_base = OTHER; note = 2'-O-methyladenosine
  modified_base 16: mod_base = gm
  modified_base 17: mod_base = um
  modified_base 18: mod_base = OTHER; note = 2'-O-methyladenosine
  modified_base 19: mod_base = gm
  modified_base 20: mod_base = um
  modified_base 21: mod_base = OTHER; note = 2'-O-methyladenosine
  source 1..21: mol_type = other RNA
gtnatcagctggggagtagta

SEQ ID NO: 1080 - RNA, 21 nt, synthetic construct
  modified_base 1: mod_base = gm
  modified_base 2: mod_base = OTHER; note = 2'-O-methyladenosine
  modified_base 3: mod_base = um
  modified_base 4: mod_base = cm
  modified_base 5: mod_base = OTHER; note = 2'-O-methyladenosine
  modified_base 6: mod_base = gm
  modified_base 7: mod_base = cm
  modified_base 8: mod_base = um
  modified_base 9: mod_base = OTHER; note = 2'-fluoroguanosine
  modified_base 10: mod_base = OTHER; note = 2'-fluoroguanosine
  modified_base 11: mod_base = OTHER; note = 2'-fluoroguanosine
  modified_base 12: mod_base = gm
  modified_base 13: mod_base = OTHER; note = 2'-O-methyladenosine
  modified_base 14: mod_base = gm
  modified_base 15: mod_base = um
  modified_base 16: mod_base = OTHER; note = 2'-O-methyladenosine
  modified_base 17: mod_base = gm
  modified_base 18: mod_base = um
  modified_base 19: mod_base = OTHER; note = 2'-O-methylinosine
  modified_base 20: mod_base = gm
  modified_base 21: mod_base = OTHER; note = 2'-O-methyladenosine
  source 1..21: mol_type = other RNA
gatcagctggggagtagtnga

SEQ ID NO: 1081 - RNA, 21 nt, synthetic construct
  modified_base 1: mod_base = OTHER; note = 2'-O-methyladenosine
  modified_base 2: mod_base = gm
  modified_base 3: mod_base = cm
  modified_base 4: mod_base = um
  modified_base 5: mod_base = gm
  modified_base 6: mod_base = gm
  modified_base 7: mod_base = gm
  modified_base 8: mod_base = gm
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluorouridine
  modified_base 12: mod_base = OTHER; note = 2'-O-methyladenosine
  modified_base 13: mod_base = gm
  modified_base 14: mod_base = um
  modified_base 15: mod_base = gm
  modified_base 16: mod_base = OTHER; note = 2'-O-methylinosine
  modified_base 17: mod_base = OTHER; note = 2'-O-methyladenosine
  modified_base 18: mod_base = um
  modified_base 19: mod_base = gm
  modified_base 20: mod_base = um
  modified_base 21: mod_base = OTHER; note = 2'-O-methyladenosine
  source 1..21: mol_type = other RNA
agctggggagtagtgnatgta

SEQ ID NO: 1082 - RNA, 21 nt, synthetic construct
  modified_base 1: mod_base = cm
  modified_base 2: mod_base = um
  modified_base 3: mod_base = gm
  modified_base 4: mod_base = gm
  modified_base 5: mod_base = gm
  modified_base 6: mod_base = gm
  modified_base 7: mod_base = OTHER; note = 2'-O-methyladenosine
  modified_base 8: mod_base = gm
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroguanosine
  modified_base 12: mod_base = um
  modified_base 13: mod_base = gm
  modified_base 14: mod_base = gm
  modified_base 15: mod_base = OTHER; note = 2'-O-methyladenosine
  modified_base 16: mod_base = um
  modified_base 17: mod_base = gm
  modified_base 18: mod_base = um
  modified_base 19: mod_base = cm
  modified_base 20: mod_base = um
  modified_base 21: mod_base = OTHER; note = 2'-O-methyladenosine
  source 1..21: mol_type = other RNA
ctggggagtagtggatgtcta

SEQ ID NO: 1083 - RNA, 21 nt, synthetic construct
  modified_base 1: mod_base = um
  modified_base 2: mod_base = cm
  modified_base 3: mod_base = cm
  modified_base 4: mod_base = OTHER; note = 2'-O-methyladenosine
  modified_base 5: mod_base = OTHER; note = 2'-O-methyladenosine
  modified_base 6: mod_base = gm
  modified_base 7: mod_base = OTHER; note = 2'-O-methyladenosine
  modified_base 8: mod_base = um
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluoroguanosine
  modified_base 12: mod_base = gm
  modified_base 13: mod_base = OTHER; note = 2'-O-methyladenosine
  modified_base 14: mod_base = um
  modified_base 15: mod_base = um
  modified_base 16: mod_base = um
  modified_base 17: mod_base = gm
  modified_base 18: mod_base = OTHER; note = 2'-O-methylinosine
  modified_base 19: mod_base = gm
  modified_base 20: mod_base = um
  modified_base 21: mod_base = um
  source 1..21: mol_type = other RNA
tccaagatgaggatttgngtt

SEQ ID NO: 1084 - RNA, 21 nt, synthetic construct
  modified_base 1: mod_base = cm
  modified_base 2: mod_base = cm
  modified_base 3: mod_base = OTHER; note = 2'-O-methyladenosine
  modified_base 4: mod_base = OTHER; note = 2'-O-methyladenosine
  modified_base 5: mod_base = gm
  modified_base 6: mod_base = OTHER; note = 2'-O-methyladenosine
  modified_base 7: mod_base = um
  modified_base 8: mod_base = gm
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluoroguanosine
  modified_base 12: mod_base = OTHER; note = 2'-O-methyladenosine
  modified_base 13: mod_base = um
  modified_base 14: mod_base = um
  modified_base 15: mod_base = um
  modified_base 16: mod_base = gm
  modified_base 17: mod_base = OTHER; note = 2'-O-methylinosine
  modified_base 18: mod_base = gm
  modified_base 19: mod_base = um
  modified_base 20: mod_base = um
  modified_base 21: mod_base = um
  source 1..21: mol_type = other RNA
ccaagatgaggatttgngttt

SEQ ID NO: 1085 - RNA, 21 nt, synthetic construct
  modified_base 1: mod_base = gm
  modified_base 2: mod_base = OTHER; note = 2'-O-methyladenosine
  modified_base 3: mod_base = um
  modified_base 4: mod_base = gm
  modified_base 5: mod_base = OTHER; note = 2'-O-methyladenosine
  modified_base 6: mod_base = gm
  modified_base 7: mod_base = gm
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorouridine
  modified_base 11: mod_base = OTHER; note = 2'-fluorouridine
  modified_base 12: mod_base = gm
  modified_base 13: mod_base = gm
  modified_base 14: mod_base = gm
  modified_base 15: mod_base = um
  modified_base 16: mod_base = um
  modified_base 17: mod_base = um
  modified_base 18: mod_base = um
  modified_base 19: mod_base = cm
  modified_base 20: mod_base = um
  modified_base 21: mod_base = OTHER; note = 2'-O-methyladenosine
  source 1..21: mol_type = other RNA
gatgaggatttgggttttcta

SEQ ID NO: 1086 - RNA, 21 nt, synthetic construct
  modified_base 1: mod_base = gm
  modified_base 2: mod_base = OTHER; note = 2'-O-methyladenosine
  modified_base 3: mod_base = um
  modified_base 4: mod_base = gm
  modified_base 5: mod_base = OTHER; note = 2'-O-methyladenosine
  modified_base 6: mod_base = gm
  modified_base 7: mod_base = gm
  modified_base 8: mod_base = OTHER; note = 2'-O-methyladenosine
  modified_base 9: mod_base = OTHER; note = 2'-fluorouridine
  modified_base 10: mod_base = um
  modified_base 11: mod_base = OTHER; note = 2'-fluorouridine
  modified_base 12: mod_base = OTHER; note = 2'-fluoroguanosine
  modified_base 13: mod_base = gm
  modified_base 14: mod_base = gm
  modified_base 15: mod_base = um
  modified_base 16: mod_base = um
  modified_base 17: mod_base = um
  modified_base 18: mod_base = um
  modified_base 19: mod_base = cm
  modified_base 20: mod_base = um
  modified_base 21: mod_base = OTHER; note = 2'-O-methyladenosine
  source 1..21: mol_type = other RNA
gatgaggatttgggttttcta

SEQ ID NO: 1087 - RNA, 21 nt, synthetic construct
  modified_base 1: mod_base = gm
  modified_base 2: mod_base = OTHER; note = 2'-O-methyladenosine
  modified_base 3: mod_base = um
  modified_base 4: mod_base = gm
  modified_base 5: mod_base = OTHER; note = 2'-O-methyladenosine
  modified_base 6: mod_base = gm
  modified_base 7: mod_base = gm
  modified_base 8: mod_base = OTHER; note = 2'-O-methyladenosine
  modified_base 9: mod_base = OTHER; note = 2'-fluorouridine
  modified_base 10: mod_base = um
  modified_base 11: mod_base = OTHER; note = 2'-fluorouridine
  modified_base 12: mod_base = gm
  modified_base 13: mod_base = OTHER; note = 2'-fluoroguanosine
  modified_base 14: mod_base = gm
  modified_base 15: mod_base = um
  modified_base 16: mod_base = um
  modified_base 17: mod_base = um
  modified_base 18: mod_base = um
  modified_base 19: mod_base = cm
  modified_base 20: mod_base = um
  modified_base 21: mod_base = OTHER; note = 2'-O-methyladenosine
  source 1..21: mol_type = other RNA
gatgaggatttgggttttcta

SEQ ID NO: 1088 - RNA, 21 nt, synthetic construct
  modified_base 1: mod_base = gm
  modified_base 2: mod_base = OTHER; note = 2'-O-methyladenosine
  modified_base 3: mod_base = um
  modified_base 4: mod_base = gm
  modified_base 5: mod_base = OTHER; note = 2'-O-methyladenosine
  modified_base 6: mod_base = gm
  modified_base 7: mod_base = OTHER; note = 2'-fluoroguanosine
  modified_base 8: mod_base = OTHER; note = 2'-O-methyladenosine
  modified_base 9: mod_base = OTHER; note = 2'-fluorouridine
  modified_base 10: mod_base = um
  modified_base 11: mod_base = OTHER; note = 2'-fluorouridine
  modified_base 12: mod_base = gm
  modified_base 13: mod_base = gm
  modified_base 14: mod_base = gm
  modified_base 15: mod_base = um
  modified_base 16: mod_base = um
  modified_base 17: mod_base = um
  modified_base 18: mod_base = um
  modified_base 19: mod_base = cm
  modified_base 20: mod_base = um
  modified_base 21: mod_base = OTHER; note = 2'-O-methyladenosine
  source 1..21: mol_type = other RNA
gatgaggatttgggttttcta

SEQ ID NO: 1089 - RNA, 21 nt, synthetic construct
  modified_base 1: mod_base = cm
  modified_base 2: mod_base = OTHER; note = 2'-O-methyladenosine
  modified_base 3: mod_base = cm
  modified_base 4: mod_base = um
  modified_base 5: mod_base = gm
  modified_base 6: mod_base = cm
  modified_base 7: mod_base = um
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluoroguanosine
  modified_base 11: mod_base = OTHER; note = 2'-fluoroadenosine
  modified_base 12: mod_base = cm
  modified_base 13: mod_base = gm
  modified_base 14: mod_base = gm
  modified_base 15: mod_base = um
  modified_base 16: mod_base = um
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = cm
  modified_base 21: mod_base = um
  source 1..21: mol_type = other RNA
cactgctatgacggttacact

SEQ ID NO: 1090 - RNA, 21 nt, synthetic construct
  modified_base 1: mod_base = gm
  modified_base 2: mod_base = cm
  modified_base 3: mod_base = cm
  modified_base 4: mod_base = OTHER; note = 2'-O-methyladenosine
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluoroguanosine
  modified_base 12: mod_base = um
  modified_base 13: mod_base = cm
  modified_base 14: mod_base = um
  modified_base 15: mod_base = OTHER; note = 2'-O-methyladenosine
  modified_base 16: mod_base = gm
  modified_base 17: mod_base = um
  modified_base 18: mod_base = cm
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
gccaaaaagtgtctagtcaaa

SEQ ID NO: 1091 - RNA, 21 nt, synthetic construct
  modified_base 1: mod_base = cm
  modified_base 2: mod_base = OTHER; note = 2'-O-methyl-2-aminoadenosine
  modified_base 3: mod_base = OTHER; note = 2'-O-methyladenosine
  modified_base 4: mod_base = OTHER; note = 2'-O-methyladenosine
  modified_base 5: mod_base = OTHER; note = 2'-O-methyladenosine
  modified_base 6: mod_base = OTHER; note = 2'-O-methyladenosine
  modified_base 7: mod_base = gm
  modified_base 8: mod_base = um
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = OTHER; note = 2'-O-methyladenosine
  modified_base 14: mod_base = gm
  modified_base 15: mod_base = um
  modified_base 16: mod_base = cm
  modified_base 17: mod_base = OTHER; note = 2'-O-methyladenosine
  modified_base 18: mod_base = OTHER; note = 2'-O-methyladenosine
  modified_base 19: mod_base = cm
  modified_base 20: mod_base = um
  modified_base 21: mod_base = um
  source 1..21: mol_type = other RNA
cnaaaagtgtctagtcaactt

SEQ ID NO: 1092 - RNA, 21 nt, synthetic construct
  modified_base 1: mod_base = OTHER; note = 2'-O-methyladenosine
  modified_base 2: mod_base = gm
  modified_base 3: mod_base = OTHER; note = 2'-O-methyladenosine
  modified_base 4: mod_base = OTHER; note = 2'-O-methyladenosine
  modified_base 5: mod_base = gm
  modified_base 6: mod_base = gm
  modified_base 7: mod_base = um
  modified_base 8: mod_base = gm
  modified_base 9: mod_base = OTHER; note = 2'-fluoroguanosine
  modified_base 10: mod_base = OTHER; note = 2'-fluorocytidine
  modified_base 11: mod_base = OTHER; note = 2'-fluoroadenosine
  modified_base 12: mod_base = OTHER; note = 2'-O-methyladenosine
  modified_base 13: mod_base = gm
  modified_base 14: mod_base = um
  modified_base 15: mod_base = um
  modified_base 16: mod_base = OTHER; note = 2'-O-methyladenosine
  modified_base 17: mod_base = um
  modified_base 18: mod_base = gm
  modified_base 19: mod_base = gm
  modified_base 20: mod_base = um
  modified_base 21: mod_base = OTHER; note = 2'-O-methyladenosine
  source 1..21: mol_type = other RNA
agaaggtggcaagttatggta

SEQ ID NO: 1093 - RNA, 21 nt, synthetic construct
  modified_base 1: mod_base = cm
  modified_base 2: mod_base = um
  modified_base 3: mod_base = gm
  modified_base 4: mod_base = OTHER; note = 2'-O-methyladenosine
  modified_base 5: mod_base = um
  modified_base 6: mod_base = gm
  modified_base 7: mod_base = gm
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorouridine
  modified_base 11: mod_base = OTHER; note = 2'-fluoroguanosine
  modified_base 12: mod_base = cm
  modified_base 13: mod_base = OTHER; note = 2'-O-methyladenosine
  modified_base 14: mod_base = cm
  modified_base 15: mod_base = OTHER; note = 2'-O-methyladenosine
  modified_base 16: mod_base = OTHER; note = 2'-O-methyladenosine
  modified_base 17: mod_base = cm
  modified_base 18: mod_base = OTHER; note = 2'-O-methyladenosine
  modified_base 19: mod_base = um
  modified_base 20: mod_base = gm
  modified_base 21: mod_base = OTHER; note = 2'-O-methyladenosine
  source 1..21: mol_type = other RNA
ctgatggattgcacaacatga

SEQ ID NO: 1094 - RNA, 21 nt, synthetic construct
  modified_base 1: mod_base = cm
  modified_base 2: mod_base = cm
  modified_base 3: mod_base = cm
  modified_base 4: mod_base = OTHER; note = 2'-O-methyladenosine
  modified_base 5: mod_base = OTHER; note = 2'-O-methyladenosine
  modified_base 6: mod_base = um
  modified_base 7: mod_base = um
  modified_base 8: mod_base = OTHER; note = 2'-O-methyladenosine
  modified_base 9: mod_base = OTHER; note = 2'-fluorocytidine
  modified_base 10: mod_base = OTHER; note = 2'-fluorouridine
  modified_base 11: mod_base = OTHER; note = 2'-fluoroguanosine
  modified_base 12: mod_base = um
  modified_base 13: mod_base = cm
  modified_base 14: mod_base = OTHER; note = 2'-O-methyladenosine
  modified_base 15: mod_base = um
  modified_base 16: mod_base = um
  modified_base 17: mod_base = gm
  modified_base 18: mod_base = OTHER; note = 2'-O-methyladenosine
  modified_base 19: mod_base = um
  modified_base 20: mod_base = gm
  modified_base 21: mod_base = OTHER; note = 2'-O-methyladenosine
  source 1..21: mol_type = other RNA
cccaattactgtcattgatga

SEQ ID NO: 1095 - RNA, 21 nt, synthetic construct
  modified_base 1: mod_base = gm
  modified_base 2: mod_base = OTHER; note = 2'-O-methyladenosine
  modified_base 3: mod_base = OTHER; note = 2'-O-methyladenosine
  modified_base 4: mod_base = cm
  modified_base 5: mod_base = cm
  modified_base 6: mod_base = OTHER; note = 2'-O-methyladenosine
  modified_base 7: mod_base = OTHER; note = 2'-O-methyladenosine
  modified_base 8: mod_base = gm
  modified_base 9: mod_base = OTHER; note = 2'-fluorouridine
  modified_base 10: mod_base = OTHER; note = 2'-fluoroguanosine
  modified_base 11: mod_base = OTHER; note = 2'-fluoroadenosine
  modified_base 12: mod_base = OTHER; note = 2'-O-methyladenosine
  modified_base 13: mod_base = cm
  modified_base 14: mod_base = OTHER; note = 2'-O-methyladenosine
  modified_base 15: mod_base = um
  modified_base 16: mod_base = cm
  modified_base 17: mod_base = OTHER; note = 2'-O-methyladenosine
  modified_base 18: mod_base = OTHER; note = 2'-O-methyladenosine
  modified_base 19: mod_base = um
  modified_base 20: mod_base = gm
  modified_base 21: mod_base = OTHER; note = 2'-O-methyladenosine
  source 1..21: mol_type = other RNA
gaaccaagtgaacatcaatga

SEQ ID NO: 1096 - RNA, 21 nt, synthetic construct
  modified_base 1: mod_base = gm
  modified_base 2: mod_base = gm
  modified_base 3: mod_base = um
  modified_base 4: mod_base = OTHER; note = 2'-O-methyladenosine
  modified_base 5: mod_base = cm
  modified_base 6: mod_base = cm
  modified_base 7: mod_base = gm
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorouridine
  modified_base 11: mod_base = OTHER; note = 2'-fluoroadenosine
  modified_base 12: mod_base = cm
  modified_base 13: mod_base = cm
  modified_base 14: mod_base = OTHER; note = 2'-O-methyladenosine
  modified_base 15: mod_base = cm
  modified_base 16: mod_base = OTHER; note = 2'-O-methyladenosine
  modified_base 17: mod_base = OTHER; note = 2'-O-methyladenosine
  modified_base 18: mod_base = OTHER; note = 2'-O-methylinosine
  modified_base 19: mod_base = cm
  modified_base 20: mod_base = OTHER; note = 2'-O-methyladenosine
  modified_base 21: mod_base = OTHER; note = 2'-O-methyladenosine
  source 1..21: mol_type = other RNA
ggtaccgattaccacaancaa

SEQ ID NO: 1097 - RNA, 21 nt, synthetic construct
  modified_base 1: mod_base = cm
  modified_base 2: mod_base = OTHER; note = 2'-O-methyladenosine
  modified_base 3: mod_base = cm
  modified_base 4: mod_base = cm
  modified_base 5: mod_base = gm
  modified_base 6: mod_base = OTHER; note = 2'-O-methyladenosine
  modified_base 7: mod_base = um
  modified_base 8: mod_base = um
  modified_base 9: mod_base = OTHER; note = 2'-fluoroadenosine
  modified_base 10: mod_base = OTHER; note = 2'-fluorocytidine
  modified_base 11: mod_base = OTHER; note = 2'-fluorocytidine
  modified_base 12: mod_base = OTHER; note = 2'-O-methyladenosine
  modified_base 13: mod_base = cm
  modified_base 14: mod_base = OTHER; note = 2'-O-methyladenosine
  modified_base 15: mod_base = OTHER; note = 2'-O-methyladenosine
  modified_base 16: mod_base = OTHER; note = 2'-O-methylinosine
  modified_base 17: mod_base = cm
  modified_base 18: mod_base = OTHER; note = 2'-O-methyladenosine
  modified_base 19: mod_base = OTHER; note = 2'-O-methyladenosine
  modified_base 20: mod_base = cm
  modified_base 21: mod_base = OTHER; note = 2'-O-methyladenosine
  source 1..21: mol_type = other RNA
caccgattaccacaancaaca

SEQ ID NO: 1098 - RNA, 21 nt, synthetic construct
  modified_base 1: mod_base = cm
  modified_base 2: mod_base = OTHER; note = 2'-O-methyladenosine
  modified_base 3: mod_base = um
  modified_base 4: mod_base = gm
  modified_base 5: mod_base = gm
  modified_base 6: mod_base = cm
  modified_base 7: mod_base = OTHER; note = 2'-O-methyladenosine
  modified_base 8: mod_base = gm
  modified_base 9: mod_base = OTHER; note = 2'-fluoroguanosine
  modified_base 10: mod_base = OTHER; note = 2'-fluorocytidine
  modified_base 11: mod_base = OTHER; note = 2'-fluorocytidine
  modified_base 12: mod_base = OTHER; note = 2'-O-methyladenosine
  modified_base 13: mod_base = OTHER; note = 2'-O-methyladenosine
  modified_base 14: mod_base = gm
  modified_base 15: mod_base = OTHER; note = 2'-O-methyladenosine
  modified_base 16: mod_base = um
  modified_base 17: mod_base = cm
  modified_base 18: mod_base = um
  modified_base 19: mod_base = cm
  modified_base 20: mod_base = OTHER; note = 2'-O-methyladenosine
  modified_base 21: mod_base = OTHER; note = 2'-O-methyladenosine
  source 1..21: mol_type = other RNA
catggcaggccaagatctcaa

SEQ ID NO: 1099 - RNA, 21 nt, synthetic construct
  modified_base 1: mod_base = gm
  modified_base 2: mod_base = um
  modified_base 3: mod_base = gm
  modified_base 4: mod_base = OTHER; note = 2'-O-methyladenosine
  modified_base 5: mod_base = cm
  modified_base 6: mod_base = gm
  modified_base 7: mod_base = um
  modified_base 8: mod_base = um
  modified_base 9: mod_base = OTHER; note = 2'-fluoroguanosine
  modified_base 10: mod_base = OTHER; note = 2'-fluorocytidine
  modified_base 11: mod_base = OTHER; note = 2'-fluorocytidine
  modified_base 12: mod_base = cm
  modified_base 13: mod_base = um
  modified_base 14: mod_base = gm
  modified_base 15: mod_base = OTHER; note = 2'-O-methyladenosine
  modified_base 16: mod_base = um
  modified_base 17: mod_base = cm
  modified_base 18: mod_base = OTHER; note = 2'-O-methyladenosine
  modified_base 19: mod_base = OTHER; note = 2'-O-methyladenosine
  modified_base 20: mod_base = gm
  modified_base 21: mod_base = OTHER; note = 2'-O-methyladenosine
  source 1..21: mol_type = other RNA
gtgacgttgccctgatcaaga

SEQ ID NO: 1100 - RNA, 21 nt, synthetic construct
  modified_base 1: mod_base = um
  modified_base 2: mod_base = gm
  modified_base 3: mod_base = OTHER; note = 2'-O-methyladenosine
  modified_base 4: mod_base = cm
  modified_base 5: mod_base = gm
  modified_base 6: mod_base = um
  modified_base 7: mod_base = um
  modified_base 8: mod_base = gm
  modified_base 9: mod_base = OTHER; note = 2'-fluorocytidine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = gm
  modified_base 14: mod_base = OTHER; note = 2'-O-methyladenosine
  modified_base 15: mod_base = um
  modified_base 16: mod_base = cm
  modified_base 17: mod_base = OTHER; note = 2'-O-methyladenosine
  modified_base 18: mod_base = OTHER; note = 2'-O-methyladenosine
  modified_base 19: mod_base = OTHER; note = 2'-O-methylinosine
  modified_base 20: mod_base = cm
  modified_base 21: mod_base = um
  source 1..21: mol_type = other RNA
tgacgttgccctgatcaanct

SEQ ID NO: 1101 - RNA, 21 nt, synthetic construct
  modified_base 1: mod_base = um
  modified_base 2: mod_base = OTHER; note = 2'-O-methyladenosine
  modified_base 3: mod_base = cm
  modified_base 4: mod_base = gm
  modified_base 5: mod_base = um
  modified_base 6: mod_base = gm
  modified_base 7: mod_base = um
  modified_base 8: mod_base = gm
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = um
  modified_base 14: mod_base = cm
  modified_base 15: mod_base = um
  modified_base 16: mod_base = gm
  modified_base 17: mod_base = OTHER; note = 2'-O-methylinosine
  modified_base 18: mod_base = cm
  modified_base 19: mod_base = um
  modified_base 20: mod_base = um
  modified_base 21: mod_base = OTHER; note = 2'-O-methyladenosine
  source 1..21: mol_type = other RNA
tacgtgtgtccttctgnctta

SEQ ID NO: 1102 - RNA, 21 nt, synthetic construct
  modified_base 1: mod_base = um
  modified_base 2: mod_base = gm
  modified_base 3: mod_base = um
  modified_base 4: mod_base = gm
  modified_base 5: mod_base = OTHER; note = 2'-O-methyladenosine
  modified_base 6: mod_base = gm
  modified_base 7: mod_base = um
  modified_base 8: mod_base = gm
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluoroguanosine
  modified_base 12: mod_base = OTHER; note = 2'-O-methyladenosine
  modified_base 13: mod_base = gm
  modified_base 14: mod_base = OTHER; note = 2'-O-methyladenosine
  modified_base 15: mod_base = um
  modified_base 16: mod_base = cm
  modified_base 17: mod_base = um
  modified_base 18: mod_base = cm
  modified_base 19: mod_base = um
  modified_base 20: mod_base = um
  modified_base 21: mod_base = um
  source 1..21: mol_type = other RNA
tgtgagtgatgagatctcttt

SEQ ID NO: 1103 - RNA, 21 nt, synthetic construct
  modified_base 1: mod_base = um
  modified_base 2: mod_base = gm
  modified_base 3: mod_base = OTHER; note = 2'-O-methyladenosine
  modified_base 4: mod_base = gm
  modified_base 5: mod_base = um
  modified_base 6: mod_base = gm
  modified_base 7: mod_base = OTHER; note = 2'-O-methyladenosine
  modified_base 8: mod_base = um
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluoroguanosine
  modified_base 12: mod_base = OTHER; note = 2'-O-methyladenosine
  modified_base 13: mod_base = um
  modified_base 14: mod_base = cm
  modified_base 15: mod_base = um
  modified_base 16: mod_base = cm
  modified_base 17: mod_base = um
  modified_base 18: mod_base = um
  modified_base 19: mod_base = um
  modified_base 20: mod_base = cm
  modified_base 21: mod_base = OTHER; note = 2'-O-methyladenosine
  source 1..21: mol_type = other RNA
tgagtgatgagatctctttca

SEQ ID NO: 1104 - RNA, 21 nt, synthetic construct
  modified_base 1: mod_base = cm
  modified_base 2: mod_base = um
  modified_base 3: mod_base = gm
  modified_base 4: mod_base = cm
  modified_base 5: mod_base = cm
  modified_base 6: mod_base = OTHER; note = 2'-O-methyladenosine
  modified_base 7: mod_base = OTHER; note = 2'-O-methyladenosine
  modified_base 8: mod_base = gm
  modified_base 9: mod_base = OTHER; note = 2'-fluoroadenosine
  modified_base 10: mod_base = OTHER; note = 2'-fluorocytidine
  modified_base 11: mod_base = OTHER; note = 2'-fluorouridine
  modified_base 12: mod_base = cm
  modified_base 13: mod_base = cm
  modified_base 14: mod_base = um
  modified_base 15: mod_base = um
  modified_base 16: mod_base = cm
  modified_base 17: mod_base = OTHER; note = 2'-O-methyladenosine
  modified_base 18: mod_base = um
  modified_base 19: mod_base = gm
  modified_base 20: mod_base = um
  modified_base 21: mod_base = OTHER; note = 2'-O-methyladenosine
  source 1..21: mol_type = other RNA
ctgccaagactccttcatgta

SEQ ID NO: 1105 - RNA, 21 nt, synthetic construct
  modified_base 1: mod_base = cm
  modified_base 2: mod_base = cm
  modified_base 3: mod_base = OTHER; note = 2'-O-methyladenosine
  modified_base 4: mod_base = OTHER; note = 2'-O-methyladenosine
  modified_base 5: mod_base = gm
  modified_base 6: mod_base = OTHER; note = 2'-O-methyladenosine
  modified_base 7: mod_base = cm
  modified_base 8: mod_base = um
  modified_base 9: mod_base = OTHER; note = 2'-fluorocytidine
  modified_base 10: mod_base = OTHER; note = 2'-fluorocytidine
  modified_base 11: mod_base = OTHER; note = 2'-fluorouridine
  modified_base 12: mod_base = um
  modified_base 13: mod_base = cm
  modified_base 14: mod_base = OTHER; note = 2'-O-methyladenosine
  modified_base 15: mod_base = um
  modified_base 16: mod_base = gm
  modified_base 17: mod_base = um
  modified_base 18: mod_base = OTHER; note = 2'-O-methyladenosine
  modified_base 19: mod_base = cm
  modified_base 20: mod_base = OTHER; note = 2'-O-methylinosine
  modified_base 21: mod_base = OTHER; note = 2'-O-methyladenosine
  source 1..21: mol_type = other RNA
ccaagactccttcatgtacna

SEQ ID NO: 1106 - RNA, 21 nt, synthetic construct
  modified_base 1: mod_base = OTHER; note = 2'-O-methyladenosine
  modified_base 2: mod_base = gm
  modified_base 3: mod_base = OTHER; note = 2'-O-methyladenosine
  modified_base 4: mod_base = cm
  modified_base 5: mod_base = um
  modified_base 6: mod_base = cm
  modified_base 7: mod_base = cm
  modified_base 8: mod_base = um
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluoroadenosine
  modified_base 12: mod_base = um
  modified_base 13: mod_base = gm
  modified_base 14: mod_base = um
  modified_base 15: mod_base = OTHER; note = 2'-O-methyladenosine
  modified_base 16: mod_base = cm
  modified_base 17: mod_base = OTHER; note = 2'-O-methylinosine
  modified_base 18: mod_base = OTHER; note = 2'-O-methyladenosine
  modified_base 19: mod_base = cm
  modified_base 20: mod_base = OTHER; note = 2'-O-methyladenosine
  modified_base 21: mod_base = OTHER; note = 2'-O-methyladenosine
  source 1..21: mol_type = other RNA
agactccttcatgtacnacaa

SEQ ID NO: 1107 - RNA, 21 nt, synthetic construct
  modified_base 1: mod_base = gm
  modified_base 2: mod_base = OTHER; note = 2'-O-methyladenosine
  modified_base 3: mod_base = gm
  modified_base 4: mod_base = OTHER; note = 2'-O-methyladenosine
  modified_base 5: mod_base = cm
  modified_base 6: mod_base = cm
  modified_base 7: mod_base = OTHER; note = 2'-O-methyladenosine
  modified_base 8: mod_base = um
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluoroadenosine
  modified_base 12: mod_base = OTHER; note = 2'-O-methyladenosine
  modified_base 13: mod_base = gm
  modified_base 14: mod_base = gm
  modified_base 15: mod_base = OTHER; note = 2'-O-methyladenosine
  modified_base 16: mod_base = OTHER; note = 2'-O-methylinosine
  modified_base 17: mod_base = um
  modified_base 18: mod_base = cm
  modified_base 19: mod_base = gm
  modified_base 20: mod_base = OTHER; note = 2'-O-methyladenosine
  modified_base 21: mod_base = um
  source 1..21: mol_type = other RNA
gagaccatagaaggantcgat

SEQ ID NO: 1108 - RNA, 21 nt, synthetic construct
  modified_base 1: mod_base = gm
  modified_base 2: mod_base = cm
  modified_base 3: mod_base = um
  modified_base 4: mod_base = cm
  modified_base 5: mod_base = cm
  modified_base 6: mod_base = OTHER; note = 2'-O-methyladenosine
  modified_base 7: mod_base = um
  modified_base 8: mod_base = gm
  modified_base 9: mod_base = OTHER; note = 2'-fluoroadenosine
  modified_base 10: mod_base = OTHER; note = 2'-fluoroadenosine
  modified_base 11: mod_base = OTHER; note = 2'-fluorocytidine
  modified_base 12: mod_base = OTHER; note = 2'-O-methyladenosine
  modified_base 13: mod_base = um
  modified_base 14: mod_base = cm
  modified_base 15: mod_base = um
  modified_base 16: mod_base = OTHER; note = 2'-O-methyladenosine
  modified_base 17: mod_base = cm
  modified_base 18: mod_base = cm
  modified_base 19: mod_base = um
  modified_base 20: mod_base = OTHER; note = 2'-O-methylinosine
  modified_base 21: mod_base = OTHER; note = 2'-O-methyladenosine
  source 1..21: mol_type = other RNA
gctccatgaacatctacctna

SEQ ID NO: 1109 - RNA, 21 nt, synthetic construct
  modified_base 1: mod_base = gm
  modified_base 2: mod_base = OTHER; note = 2'-O-methyladenosine
  modified_base 3: mod_base = OTHER; note = 2'-O-methyladenosine
  modified_base 4: mod_base = cm
  modified_base 5: mod_base = OTHER; note = 2'-O-methyladenosine
  modified_base 6: mod_base = um
  modified_base 7: mod_base = cm
  modified_base 8: mod_base = um
  modified_base 9: mod_base = OTHER; note = 2'-fluoroadenosine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = gm
  modified_base 14: mod_base = gm
  modified_base 15: mod_base = um
  modified_base 16: mod_base = OTHER; note = 2'-O-methylinosine
  modified_base 17: mod_base = cm
  modified_base 18: mod_base = um
  modified_base 19: mod_base = OTHER; note = 2'-O-methyladenosine
  modified_base 20: mod_base = gm
  modified_base 21: mod_base = OTHER; note = 2'-O-methyladenosine
  source 1..21: mol_type = other RNA
gaacatctacctggtnctaga

SEQ ID NO: 1110 - RNA, 21 nt, synthetic construct
  modified_base 1: mod_base = gm
  modified_base 2: mod_base = um
  modified_base 3: mod_base = gm
  modified_base 4: mod_base = gm
  modified_base 5: mod_base = OTHER; note = 2'-O-methyladenosine
  modified_base 6: mod_base = um
  modified_base 7: mod_base = cm
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluorocytidine
  modified_base 12: mod_base = OTHER; note = 2'-O-methyladenosine
  modified_base 13: mod_base = gm
  modified_base 14: mod_base = cm
  modified_base 15: mod_base = OTHER; note = 2'-O-methyladenosine
  modified_base 16: mod_base = um
  modified_base 17: mod_base = um
  modified_base 18: mod_base = gm
  modified_base 19: mod_base = OTHER; note = 2'-O-methylinosine
  modified_base 20: mod_base = gm
  modified_base 21: mod_base = OTHER; note = 2'-O-methyladenosine
  source 1..21: mol_type = other RNA
gtggatcagacagcattgnga

SEQ ID NO: 1111 - RNA, 21 nt, synthetic construct
  modified_base 1: mod_base = gm
  modified_base 2: mod_base = OTHER; note = 2'-O-methyladenosine
  modified_base 3: mod_base = gm
  modified_base 4: mod_base = cm
  modified_base 5: mod_base = cm
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroadenosine
  modified_base 11: mod_base = OTHER; note = 2'-fluoroguanosine
  modified_base 12: mod_base = um
  modified_base 13: mod_base = gm
  modified_base 14: mod_base = um
  modified_base 15: mod_base = cm
  modified_base 16: mod_base = um
  modified_base 17: mod_base = OTHER; note = 2'-O-methyladenosine
  modified_base 18: mod_base = OTHER; note = 2'-O-methylinosine
  modified_base 19: mod_base = um
  modified_base 20: mod_base = cm
  modified_base 21: mod_base = OTHER; note = 2'-O-methyladenosine
  source 1..21: mol_type = other RNA
gagccaaaaagtgtctantca

SEQ ID NO: 1112 - RNA, 21 nt, synthetic construct
  modified_base 1: mod_base = gm
  modified_base 2: mod_base = OTHER; note = 2'-O-methyladenosine
  modified_base 3: mod_base = gm
  modified_base 4: mod_base = OTHER; note = 2'-O-methyladenosine
  modified_base 5: mod_base = OTHER; note = 2'-O-methyladenosine
  modified_base 6: mod_base = gm
  modified_base 7: mod_base = gm
  modified_base 8: mod_base = um
  modified_base 9: mod_base = OTHER; note = 2'-fluoroguanosine
  modified_base 10: mod_base = OTHER; note = 2'-fluoroguanosine
  modified_base 11: mod_base = OTHER; note = 2'-fluorocytidine
  modified_base 12: mod_base = OTHER; note = 2'-O-methyladenosine
  modified_base 13: mod_base = OTHER; note = 2'-O-methyladenosine
  modified_base 14: mod_base = gm
  modified_base 15: mod_base = um
  modified_base 16: mod_base = um
  modified_base 17: mod_base = OTHER; note = 2'-O-methyladenosine
  modified_base 18: mod_base = um
  modified_base 19: mod_base = gm
  modified_base 20: mod_base = gm
  modified_base 21: mod_base = um
  source 1..21: mol_type = other RNA
gagaaggtggcaagttatggt

SEQ ID NO: 1113 - RNA, 21 nt, synthetic construct
  modified_base 1: mod_base = gm
  modified_base 2: mod_base = OTHER; note = 2'-O-methyladenosine
  modified_base 3: mod_base = gm
  modified_base 4: mod_base = um
  modified_base 5: mod_base = um
  modified_base 6: mod_base = OTHER; note = 2'-O-methyladenosine
  modified_base 7: mod_base = um
  modified_base 8: mod_base = gm
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluoroguanosine
  modified_base 12: mod_base = um
  modified_base 13: mod_base = gm
  modified_base 14: mod_base = OTHER; note = 2'-O-methyladenosine
  modified_base 15: mod_base = OTHER; note = 2'-O-methyladenosine
  modified_base 16: mod_base = OTHER; note = 2'-O-methylinosine
  modified_base 17: mod_base = cm
  modified_base 18: mod_base = cm
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
gagttatggtgtgaanccaaa

SEQ ID NO: 1114 - RNA, 21 nt, synthetic construct
  modified_base 1: mod_base = OTHER; note = 2'-O-methyladenosine
  modified_base 2: mod_base = gm
  modified_base 3: mod_base = gm
  modified_base 4: mod_base = cm
  modified_base 5: mod_base = OTHER; note = 2'-O-methyladenosine
  modified_base 6: mod_base = gm
  modified_base 7: mod_base = um
  modified_base 8: mod_base = gm
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluorocytidine
  modified_base 12: mod_base = OTHER; note = 2'-O-methyladenosine
  modified_base 13: mod_base = gm
  modified_base 14: mod_base = cm
  modified_base 15: mod_base = OTHER; note = 2'-O-methyladenosine
  modified_base 16: mod_base = um
  modified_base 17: mod_base = gm
  modified_base 18: mod_base = OTHER; note = 2'-O-methyladenosine
  modified_base 19: mod_base = um
  modified_base 20: mod_base = gm
  modified_base 21: mod_base = OTHER; note = 2'-O-methyladenosine
  source 1..21: mol_type = other RNA
aggcagtgtacagcatgatga

SEQ ID NO: 1115 - RNA, 21 nt, synthetic construct
  modified_base 1: mod_base = gm
  modified_base 2: mod_base = gm
  modified_base 3: mod_base = OTHER; note = 2'-O-methyladenosine
  modified_base 4: mod_base = cm
  modified_base 5: mod_base = cm
  modified_base 6: mod_base = cm
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorouridine
  modified_base 11: mod_base = OTHER; note = 2'-fluoroadenosine
  modified_base 12: mod_base = cm
  modified_base 13: mod_base = um
  modified_base 14: mod_base = gm
  modified_base 15: mod_base = um
  modified_base 16: mod_base = cm
  modified_base 17: mod_base = OTHER; note = 2'-O-methyladenosine
  modified_base 18: mod_base = um
  modified_base 19: mod_base = um
  modified_base 20: mod_base = gm
  modified_base 21: mod_base = OTHER; note = 2'-O-methyladenosine
  source 1..21: mol_type = other RNA
ggacccaattactgtcattga

SEQ ID NO: 1116 - RNA, 21 nt, synthetic construct
  modified_base 1: mod_base = gm
  modified_base 2: mod_base = OTHER; note = 2'-O-methyladenosine
  modified_base 3: mod_base = cm
  modified_base 4: mod_base = cm
  modified_base 5: mod_base = cm
  modified_base 6: mod_base = OTHER; note = 2'-O-methyladenosine
  modified_base 7: mod_base = OTHER; note = 2'-O-methyladenosine
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluorocytidine
  modified_base 12: mod_base = um
  modified_base 13: mod_base = gm
  modified_base 14: mod_base = um
  modified_base 15: mod_base = cm
  modified_base 16: mod_base = OTHER; note = 2'-O-methyladenosine
  modified_base 17: mod_base = um
  modified_base 18: mod_base = um
  modified_base 19: mod_base = gm
  modified_base 20: mod_base = OTHER; note = 2'-O-methyladenosine
  modified_base 21: mod_base = um
  source 1..21: mol_type = other RNA
gacccaattactgtcattgat

SEQ ID NO: 1117 - RNA, 21 nt, synthetic construct
  modified_base 1: mod_base = cm
  modified_base 2: mod_base = OTHER; note = 2'-O-methyladenosine
  modified_base 3: mod_base = cm
  modified_base 4: mod_base = um
  modified_base 5: mod_base = gm
  modified_base 6: mod_base = um
  modified_base 7: mod_base = cm
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorouridine
  modified_base 11: mod_base = OTHER; note = 2'-fluoroguanosine
  modified_base 12: mod_base = OTHER; note = 2'-O-methyladenosine
  modified_base 13: mod_base = um
  modified_base 14: mod_base = gm
  modified_base 15: mod_base = OTHER; note = 2'-O-methyladenosine
  modified_base 16: mod_base = OTHER; note = 2'-O-methylinosine
  modified_base 17: mod_base = OTHER; note = 2'-O-methyladenosine
  modified_base 18: mod_base = um
  modified_base 19: mod_base = cm
  modified_base 20: mod_base = cm
  modified_base 21: mod_base = OTHER; note = 2'-O-methyladenosine
  source 1..21: mol_type = other RNA
cactgtcattgatganatcca

SEQ ID NO: 1118 - RNA, 21 nt, synthetic construct
  modified_base 1: mod_base = gm
  modified_base 2: mod_base = gm
  modified_base 3: mod_base = OTHER; note = 2'-O-methyladenosine
  modified_base 4: mod_base = gm
  modified_base 5: mod_base = gm
  modified_base 6: mod_base = OTHER; note = 2'-O-methyladenosine
  modified_base 7: mod_base = um
  modified_base 8: mod_base = um
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = gm
  modified_base 15: mod_base = OTHER; note = 2'-O-methyladenosine
  modified_base 16: mod_base = um
  modified_base 17: mod_base = gm
  modified_base 18: mod_base = um
  modified_base 19: mod_base = cm
  modified_base 20: mod_base = um
  modified_base 21: mod_base = OTHER; note = 2'-O-methyladenosine
  source 1..21: mol_type = other RNA
ggaggattatctggatgtcta

SEQ ID NO: 1119 - RNA, 21 nt, synthetic construct
  modified_base 1: mod_base = cm
  modified_base 2: mod_base = OTHER; note = 2'-O-methyladenosine
  modified_base 3: mod_base = um
  modified_base 4: mod_base = cm
  modified_base 5: mod_base = um
  modified_base 6: mod_base = gm
  modified_base 7: mod_base = gm
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluoroguanosine
  modified_base 11: mod_base = OTHER; note = 2'-fluorouridine
  modified_base 12: mod_base = cm
  modified_base 13: mod_base = um
  modified_base 14: mod_base = OTHER; note = 2'-O-methyladenosine
  modified_base 15: mod_base = um
  modified_base 16: mod_base = gm
  modified_base 17: mod_base = um
  modified_base 18: mod_base = gm
  modified_base 19: mod_base = um
  modified_base 20: mod_base = um
  modified_base 21: mod_base = um
  source 1..21: mol_type = other RNA
catctggatgtctatgtgttt

SEQ ID NO: 1120 - RNA, 21 nt, synthetic construct
  modified_base 1: mod_base = um
  modified_base 2: mod_base = cm
  modified_base 3: mod_base = um
  modified_base 4: mod_base = gm
  modified_base 5: mod_base = gm
  modified_base 6: mod_base = OTHER; note = 2'-O-methyladenosine
  modified_base 7: mod_base = um
  modified_base 8: mod_base = gm
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorouridine
  modified_base 12: mod_base = OTHER; note = 2'-O-methyladenosine
  modified_base 13: mod_base = um
  modified_base 14: mod_base = gm
  modified_base 15: mod_base = um
  modified_base 16: mod_base = gm
  modified_base 17: mod_base = um
  modified_base 18: mod_base = um
  modified_base 19: mod_base = um
  modified_base 20: mod_base = gm
  modified_base 21: mod_base = OTHER; note = 2'-O-methyladenosine
  source 1..21: mol_type = other RNA
tctggatgtctatgtgtttga

SEQ ID NO: 1121 - RNA, 21 nt, synthetic construct
  modified_base 1: mod_base = cm
  modified_base 2: mod_base = cm
  modified_base 3: mod_base = OTHER; note = 2'-O-methyladenosine
  modified_base 4: mod_base = OTHER; note = 2'-O-methyladenosine
  modified_base 5: mod_base = gm
  modified_base 6: mod_base = um
  modified_base 7: mod_base = gm
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluorocytidine
  modified_base 11: mod_base = OTHER; note = 2'-fluoroadenosine
  modified_base 12: mod_base = um
  modified_base 13: mod_base = cm
  modified_base 14: mod_base = OTHER; note = 2'-O-methyladenosine
  modified_base 15: mod_base = OTHER; note = 2'-O-methyladenosine
  modified_base 16: mod_base = um
  modified_base 17: mod_base = gm
  modified_base 18: mod_base = cm
  modified_base 19: mod_base = um
  modified_base 20: mod_base = um
  modified_base 21: mod_base = um
  source 1..21: mol_type = other RNA
ccaagtgaacatcaatgcttt

SEQ ID NO: 1122 - RNA, 21 nt, synthetic construct
  modified_base 1: mod_base = gm
  modified_base 2: mod_base = um
  modified_base 3: mod_base = gm
  modified_base 4: mod_base = OTHER; note = 2'-O-methyladenosine
  modified_base 5: mod_base = OTHER; note = 2'-O-methyladenosine
  modified_base 6: mod_base = cm
  modified_base 7: mod_base = OTHER; note = 2'-O-methyladenosine
  modified_base 8: mod_base = um
  modified_base 9: mod_base = OTHER; note = 2'-fluorocytidine
  modified_base 10: mod_base = OTHER; note = 2'-fluoroadenosine
  modified_base 11: mod_base = OTHER; note = 2'-fluoroadenosine
  modified_base 12: mod_base = um
  modified_base 13: mod_base = gm
  modified_base 14: mod_base = cm
  modified_base 15: mod_base = um
  modified_base 16: mod_base = um
  modified_base 17: mod_base = um
  modified_base 18: mod_base = gm
  modified_base 19: mod_base = OTHER; note = 2'-O-methylinosine
  modified_base 20: mod_base = cm
  modified_base 21: mod_base = um
  source 1..21: mol_type = other RNA
gtgaacatcaatgctttgnct

SEQ ID NO: 1123 - RNA, 21 nt, synthetic construct
  modified_base 1: mod_base = gm
  modified_base 2: mod_base = OTHER; note = 2'-O-methyladenosine
  modified_base 3: mod_base = OTHER; note = 2'-O-methyladenosine
  modified_base 4: mod_base = cm
  modified_base 5: mod_base = OTHER; note = 2'-O-methyladenosine
  modified_base 6: mod_base = um
  modified_base 7: mod_base = cm
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluoroguanosine
  modified_base 12: mod_base = cm
  modified_base 13: mod_base = um
  modified_base 14: mod_base = um
  modified_base 15: mod_base = um
  modified_base 16: mod_base = gm
  modified_base 17: mod_base = OTHER; note = 2'-O-methylinosine
  modified_base 18: mod_base = cm
  modified_base 19: mod_base = um
  modified_base 20: mod_base = um
  modified_base 21: mod_base = OTHER; note = 2'-O-methyladenosine
  source 1..21: mol_type = other RNA
gaacatcaatgctttgnctta

SEQ ID NO: 1124 - RNA, 21 nt, synthetic construct
  modified_base 1: mod_base = cm
  modified_base 2: mod_base = OTHER; note = 2'-O-methyladenosine
  modified_base 3: mod_base = OTHER; note = 2'-O-methyladenosine
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = gm
  modified_base 9: mod_base = OTHER; note = 2'-fluoroadenosine
  modified_base 10: mod_base = OTHER; note = 2'-fluorocytidine
  modified_base 11: mod_base = OTHER; note = 2'-fluoroadenosine
  modified_base 12: mod_base = OTHER; note = 2'-O-methyladenosine
  modified_base 13: mod_base = um
  modified_base 14: mod_base = gm
  modified_base 15: mod_base = OTHER; note = 2'-O-methyladenosine
  modified_base 16: mod_base = OTHER; note = 2'-O-methylinosine
  modified_base 17: mod_base = cm
  modified_base 18: mod_base = OTHER; note = 2'-O-methyladenosine
  modified_base 19: mod_base = OTHER; note = 2'-O-methyladenosine
  modified_base 20: mod_base = cm
  modified_base 21: mod_base = OTHER; note = 2'-O-methyladenosine
  source 1..21: mol_type = other RNA
caagaaagacaatgancaaca

SEQ ID NO: 1125 - RNA, 21 nt, synthetic construct
  modified_base 1: mod_base = gm
  modified_base 2: mod_base = OTHER; note = 2'-O-methyl-2-aminoadenosine
  modified_base 3: mod_base = OTHER; note = 2'-O-methyladenosine
  modified_base 4: mod_base = OTHER; note = 2'-O-methyladenosine
  modified_base 5: mod_base = gm
  modified_base 6: mod_base = OTHER; note = 2'-O-methyladenosine
  modified_base 7: mod_base = cm
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluoroguanosine
  modified_base 12: mod_base = OTHER; note = 2'-O-methyladenosine
  modified_base 13: mod_base = gm
  modified_base 14: mod_base = cm
  modified_base 15: mod_base = OTHER; note = 2'-O-methyladenosine
  modified_base 16: mod_base = OTHER; note = 2'-O-methyladenosine
  modified_base 17: mod_base = cm
  modified_base 18: mod_base = OTHER; note = 2'-O-methyladenosine
  modified_base 19: mod_base = um
  modified_base 20: mod_base = gm
  modified_base 21: mod_base = um
  source 1..21: mol_type = other RNA
gnaagacaatgagcaacatgt

SEQ ID NO: 1126 - RNA, 21 nt, synthetic construct
  modified_base 1: mod_base = gm
  modified_base 2: mod_base = gm
  modified_base 3: mod_base = um
  modified_base 4: mod_base = gm
  modified_base 5: mod_base = um
  modified_base 6: mod_base = cm
  modified_base 7: mod_base = um
  modified_base 8: mod_base = gm
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluorouridine
  modified_base 12: mod_base = OTHER; note = 2'-O-methyladenosine
  modified_base 13: mod_base = cm
  modified_base 14: mod_base = um
  modified_base 15: mod_base = um
  modified_base 16: mod_base = um
  modified_base 17: mod_base = gm
  modified_base 18: mod_base = um
  modified_base 19: mod_base = OTHER; note = 2'-O-methylinosine
  modified_base 20: mod_base = cm
  modified_base 21: mod_base = um
  source 1..21: mol_type = other RNA
ggtgtctgagtactttgtnct

SEQ ID NO: 1127 - RNA, 21 nt, synthetic construct
  modified_base 1: mod_base = gm
  modified_base 2: mod_base = um
  modified_base 3: mod_base = gm
  modified_base 4: mod_base = um
  modified_base 5: mod_base = cm
  modified_base 6: mod_base = um
  modified_base 7: mod_base = gm
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluoroadenosine
  modified_base 12: mod_base = cm
  modified_base 13: mod_base = um
  modified_base 14: mod_base = um
  modified_base 15: mod_base = um
  modified_base 16: mod_base = gm
  modified_base 17: mod_base = um
  modified_base 18: mod_base = OTHER; note = 2'-O-methylinosine
  modified_base 19: mod_base = cm
  modified_base 20: mod_base = um
  modified_base 21: mod_base = OTHER; note = 2'-O-methyladenosine
  source 1..21: mol_type = other RNA
gtgtctgagtactttgtncta

SEQ ID NO: 1128 - RNA, 21 nt, synthetic construct
  modified_base 1: mod_base = gm
  modified_base 2: mod_base = cm
  modified_base 3: mod_base = um
  modified_base 4: mod_base = gm
  modified_base 5: mod_base = OTHER; note = 2'-O-methyladenosine
  modified_base 6: mod_base = cm
  modified_base 7: mod_base = OTHER; note = 2'-O-methyladenosine
  modified_base 8: mod_base = gm
  modified_base 9: mod_base = OTHER; note = 2'-fluorocytidine
  modified_base 10: mod_base = OTHER; note = 2'-fluoroadenosine
  modified_base 11: mod_base = OTHER; note = 2'-fluoroguanosine
  modified_base 12: mod_base = cm
  modified_base 13: mod_base = OTHER; note = 2'-O-methyladenosine
  modified_base 14: mod_base = cm
  modified_base 15: mod_base = OTHER; note = 2'-O-methyladenosine
  modified_base 16: mod_base = um
  modified_base 17: mod_base = um
  modified_base 18: mod_base = gm
  modified_base 19: mod_base = um
  modified_base 20: mod_base = um
  modified_base 21: mod_base = um
  source 1..21: mol_type = other RNA
gctgacagcagcacattgttt

SEQ ID NO: 1129 - RNA, 21 nt, synthetic construct
  modified_base 1: mod_base = gm
  modified_base 2: mod_base = cm
  modified_base 3: mod_base = um
  modified_base 4: mod_base = gm
  modified_base 5: mod_base = um
  modified_base 6: mod_base = gm
  modified_base 7: mod_base = gm
  modified_base 8: mod_base = um
  modified_base 9: mod_base = OTHER; note = 2'-fluoroguanosine
  modified_base 10: mod_base = um
  modified_base 11: mod_base = OTHER; note = 2'-fluorocytidine
  modified_base 12: mod_base = OTHER; note = 2'-fluorouridine
  modified_base 13: mod_base = gm
  modified_base 14: mod_base = OTHER; note = 2'-O-methyladenosine
  modified_base 15: mod_base = gm
  modified_base 16: mod_base = um
  modified_base 17: mod_base = OTHER; note = 2'-O-methyladenosine
  modified_base 18: mod_base = cm
  modified_base 19: mod_base = um
  modified_base 20: mod_base = um
  modified_base 21: mod_base = um
  source 1..21: mol_type = other RNA
gctgtggtgtctgagtacttt

SEQ ID NO: 1130 - RNA, 21 nt, synthetic construct
  modified_base 1: mod_base = gm
  modified_base 2: mod_base = cm
  modified_base 3: mod_base = um
  modified_base 4: mod_base = gm
  modified_base 5: mod_base = um
  modified_base 6: mod_base = gm
  modified_base 7: mod_base = gm
  modified_base 8: mod_base = um
  modified_base 9: mod_base = OTHER; note = 2'-fluoroguanosine
  modified_base 10: mod_base = um
  modified_base 11: mod_base = OTHER; note = 2'-fluorocytidine
  modified_base 12: mod_base = um
  modified_base 13: mod_base = OTHER; note = 2'-fluoroguanosine
  modified_base 14: mod_base = OTHER; note = 2'-O-methyladenosine
  modified_base 15: mod_base = gm
  modified_base 16: mod_base = um
  modified_base 17: mod_base = OTHER; note = 2'-O-methyladenosine
  modified_base 18: mod_base = cm
  modified_base 19: mod_base = um
  modified_base 20: mod_base = um
  modified_base 21: mod_base = um
  source 1..21: mol_type = other RNA
gctgtggtgtctgagtacttt

SEQ ID NO: 1131 - RNA, 21 nt, synthetic construct
  modified_base 1: mod_base = gm
  modified_base 2: mod_base = cm
  modified_base 3: mod_base = um
  modified_base 4: mod_base = gm
  modified_base 5: mod_base = um
  modified_base 6: mod_base = gm
  modified_base 7: mod_base = OTHER; note = 2'-fluoroguanosine
  modified_base 8: mod_base = um
  modified_base 9: mod_base = OTHER; note = 2'-fluoroguanosine
  modified_base 10: mod_base = um
  modified_base 11: mod_base = OTHER; note = 2'-fluorocytidine
  modified_base 12: mod_base = um
  modified_base 13: mod_base = gm
  modified_base 14: mod_base = OTHER; note = 2'-O-methyladenosine
  modified_base 15: mod_base = gm
  modified_base 16: mod_base = um
  modified_base 17: mod_base = OTHER; note = 2'-O-methyladenosine
  modified_base 18: mod_base = cm
  modified_base 19: mod_base = um
  modified_base 20: mod_base = um
  modified_base 21: mod_base = um
  source 1..21: mol_type = other RNA
gctgtggtgtctgagtacttt

SEQ ID NO: 1132 - RNA, 21 nt, synthetic construct
  modified_base 1: mod_base = gm
  modified_base 2: mod_base = OTHER; note = 2'-O-methyladenosine
  modified_base 3: mod_base = um
  modified_base 4: mod_base = gm
  modified_base 5: mod_base = OTHER; note = 2'-O-methyladenosine
  modified_base 6: mod_base = gm
  modified_base 7: mod_base = gm
  modified_base 8: mod_base = OTHER; note = 2'-O-methyladenosine
  modified_base 9: mod_base = OTHER; note = 2'-fluorouridine
  modified_base 10: mod_base = um
  modified_base 11: mod_base = um
  modified_base 12: mod_base = OTHER; note = 2'-fluoroguanosine
  modified_base 13: mod_base = gm
  modified_base 14: mod_base = gm
  modified_base 15: mod_base = um
  modified_base 16: mod_base = um
  modified_base 17: mod_base = um
  modified_base 18: mod_base = um
  modified_base 19: mod_base = cm
  modified_base 20: mod_base = um
  modified_base 21: mod_base = OTHER; note = 2'-O-methyladenosine
  source 1..21: mol_type = other RNA
gatgaggatttgggttttcta

SEQ ID NO: 1133 - RNA, 21 nt, synthetic construct
  modified_base 1: mod_base = gm
  modified_base 2: mod_base = OTHER; note = 2'-O-methyladenosine
  modified_base 3: mod_base = um
  modified_base 4: mod_base = gm
  modified_base 5: mod_base = OTHER; note = 2'-O-methyladenosine
  modified_base 6: mod_base = gm
  modified_base 7: mod_base = gm
  modified_base 8: mod_base = OTHER; note = 2'-O-methyladenosine
  modified_base 9: mod_base = OTHER; note = 2'-deoxy-5-methyluridine
  modified_base 10: mod_base = um
  modified_base 11: mod_base = um
  modified_base 12: mod_base = OTHER; note = 2'-deoxyguanosine
  modified_base 13: mod_base = gm
  modified_base 14: mod_base = gm
  modified_base 15: mod_base = um
  modified_base 16: mod_base = um
  modified_base 17: mod_base = um
  modified_base 18: mod_base = um
  modified_base 19: mod_base = cm
  modified_base 20: mod_base = um
  modified_base 21: mod_base = OTHER; note = 2'-O-methyladenosine
  source 1..21: mol_type = other RNA
gatgaggatttgggttttcta

SEQ ID NO: 1134 - RNA, 21 nt, synthetic construct
  modified_base 1: mod_base = gm
  modified_base 2: mod_base = gm
  modified_base 3: mod_base = um
  modified_base 4: mod_base = gm
  modified_base 5: mod_base = OTHER; note = 2'-O-methyladenosine
  modified_base 6: mod_base = gm
  modified_base 7: mod_base = gm
  modified_base 8: mod_base = OTHER; note = 2'-O-methyladenosine
  modified_base 9: mod_base = OTHER; note = 2'-fluorouridine
  modified_base 10: mod_base = um
  modified_base 11: mod_base = OTHER; note = 2'-fluorouridine
  modified_base 12: mod_base = OTHER; note = 2'-fluoroguanosine
  modified_base 13: mod_base = gm
  modified_base 14: mod_base = gm
  modified_base 15: mod_base = um
  modified_base 16: mod_base = um
  modified_base 17: mod_base = um
  modified_base 18: mod_base = um
  modified_base 19: mod_base = cm
  modified_base 20: mod_base = um
  modified_base 21: mod_base = OTHER; note = 2'-O-methyladenosine
  source 1..21: mol_type = other RNA
ggtgaggatttgggttttcta

SEQ ID NO: 1135 - RNA, 21 nt, synthetic construct
  modified_base 1: mod_base = gm
  modified_base 2: mod_base = cm
  modified_base 3: mod_base = um
  modified_base 4: mod_base = gm
  modified_base 5: mod_base = OTHER; note = 2'-O-methyladenosine
  modified_base 6: mod_base = gm
  modified_base 7: mod_base = gm
  modified_base 8: mod_base = OTHER; note = 2'-O-methyladenosine
  modified_base 9: mod_base = OTHER; note = 2'-fluorouridine
  modified_base 10: mod_base = um
  modified_base 11: mod_base = OTHER; note = 2'-fluorouridine
  modified_base 12: mod_base = OTHER; note = 2'-fluoroguanosine
  modified_base 13: mod_base = gm
  modified_base 14: mod_base = gm
  modified_base 15: mod_base = um
  modified_base 16: mod_base = um
  modified_base 17: mod_base = um
  modified_base 18: mod_base = um
  modified_base 19: mod_base = cm
  modified_base 20: mod_base = um
  modified_base 21: mod_base = OTHER; note = 2'-O-methyladenosine
  source 1..21: mol_type = other RNA
gctgaggatttgggttttcta

SEQ ID NO: 1136 - RNA, 21 nt, synthetic construct
  modified_base 1: mod_base = gm
  modified_base 2: mod_base = cm
  modified_base 3: mod_base = um
  modified_base 4: mod_base = gm
  modified_base 5: mod_base = um
  modified_base 6: mod_base = gm
  modified_base 7: mod_base = gm
  modified_base 8: mod_base = um
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = OTHER; note = 2'-O-methyladenosine
  modified_base 15: mod_base = gm
  modified_base 16: mod_base = um
  modified_base 17: mod_base = OTHER; note = 2'-O-methyladenosine
  modified_base 18: mod_base = cm
  modified_base 19: mod_base = um
  modified_base 20: mod_base = um
  modified_base 21: mod_base = OTHER; note = 2'-O-methyladenosine
  source 1..21: mol_type = other RNA
gctgtggtgtctgagtactta

SEQ ID NO: 1137 - RNA, 21 nt, synthetic construct
  modified_base 1: mod_base = gm
  modified_base 2: mod_base = cm
  modified_base 3: mod_base = um
  modified_base 4: mod_base = gm
  modified_base 5: mod_base = um
  modified_base 6: mod_base = gm
  modified_base 7: mod_base = gm
  modified_base 8: mod_base = um
  modified_base 9: mod_base = OTHER; note = 2'-deoxyguanosine
  modified_base 10: mod_base = um
  modified_base 11: mod_base = OTHER; note = 2'-deoxyguanosine
  modified_base 12: mod_base = um
  modified_base 13: mod_base = gm
  modified_base 14: mod_base = OTHER; note = 2'-O-methyladenosine
  modified_base 15: mod_base = gm
  modified_base 16: mod_base = um
  modified_base 17: mod_base = OTHER; note = 2'-O-methyladenosine
  modified_base 18: mod_base = cm
  modified_base 19: mod_base = um
  modified_base 20: mod_base = um
  modified_base 21: mod_base = um
  source 1..21: mol_type = other RNA
gctgtggtgtctgagtacttt

SEQ ID NO: 1138 - RNA, 21 nt, synthetic construct
  modified_base 1: mod_base = OTHER; note = 2'-O-methyladenosine
  modified_base 2: mod_base = gm
  modified_base 3: mod_base = OTHER; note = 2'-O-methyladenosine
  modified_base 4: mod_base = um
  modified_base 5: mod_base = gm
  modified_base 6: mod_base = OTHER; note = 2'-O-methyladenosine
  modified_base 7: mod_base = gm
  modified_base 8: mod_base = gm
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluorouridine
  modified_base 12: mod_base = um
  modified_base 13: mod_base = gm
  modified_base 14: mod_base = gm
  modified_base 15: mod_base = gm
  modified_base 16: mod_base = um
  modified_base 17: mod_base = um
  modified_base 18: mod_base = um
  modified_base 19: mod_base = um
  modified_base 20: mod_base = cm
  modified_base 21: mod_base = um
  source 1..21: mol_type = other RNA
agatgaggatttgggttttct

SEQ ID NO: 1139 - RNA, 21 nt, synthetic construct
  modified_base 1: mod_base = gm
  modified_base 2: mod_base = OTHER; note = 2'-O-methyladenosine
  modified_base 3: mod_base = um
  modified_base 4: mod_base = gm
  modified_base 5: mod_base = OTHER; note = 2'-O-methyladenosine
  modified_base 6: mod_base = gm
  modified_base 7: mod_base = gm
  modified_base 8: mod_base = OTHER; note = 2'-O-methyladenosine
  modified_base 9: mod_base = OTHER; note = 2'-fluorouridine
  modified_base 10: mod_base = um
  modified_base 11: mod_base = OTHER; note = 2'-fluorouridine
  modified_base 12: mod_base = gm
  modified_base 13: mod_base = gm
  modified_base 14: mod_base = gm
  modified_base 15: mod_base = um
  modified_base 16: mod_base = um
  modified_base 17: mod_base = um
  modified_base 18: mod_base = um
  modified_base 19: mod_base = cm
  modified_base 20: mod_base = um
  modified_base 21: mod_base = OTHER; note = 2'-O-methyladenosine
  source 1..21: mol_type = other RNA
gatgaggatttgggttttcta

SEQ ID NO: 1140 - RNA, 21 nt, synthetic construct
  modified_base 1: mod_base = gm
  modified_base 2: mod_base = OTHER; note = 2'-O-methyladenosine
  modified_base 3: mod_base = um
  modified_base 4: mod_base = gm
  modified_base 5: mod_base = OTHER; note = 2'-O-methyladenosine
  modified_base 6: mod_base = gm
  modified_base 7: mod_base = gm
  modified_base 8: mod_base = OTHER; note = 2'-O-methyladenosine
  modified_base 9: mod_base = OTHER; note = uridine
  modified_base 10: mod_base = um
  modified_base 11: mod_base = OTHER; note = 2'-fluorouridine
  modified_base 12: mod_base = gm
  modified_base 13: mod_base = gm
  modified_base 14: mod_base = gm
  modified_base 15: mod_base = um
  modified_base 16: mod_base = um
  modified_base 17: mod_base = um
  modified_base 18: mod_base = um
  modified_base 19: mod_base = cm
  modified_base 20: mod_base = um
  modified_base 21: mod_base = OTHER; note = 2'-O-methyladenosine
  source 1..21: mol_type = other RNA
gatgaggatttgggttttcta

SEQ ID NO: 1141 - RNA, 21 nt, synthetic construct
  modified_base 1: mod_base = gm
  modified_base 2: mod_base = OTHER; note = 2'-O-methyladenosine
  modified_base 3: mod_base = um
  modified_base 4: mod_base = gm
  modified_base 5: mod_base = OTHER; note = 2'-O-methyladenosine
  modified_base 6: mod_base = gm
  modified_base 7: mod_base = gm
  modified_base 8: mod_base = OTHER; note = 2'-O-methyladenosine
  modified_base 9: mod_base = OTHER; note = 2'-fluorouridine
  modified_base 10: mod_base = um
  modified_base 11: mod_base = OTHER; note = uridine
  modified_base 12: mod_base = gm
  modified_base 13: mod_base = gm
  modified_base 14: mod_base = gm
  modified_base 15: mod_base = um
  modified_base 16: mod_base = um
  modified_base 17: mod_base = um
  modified_base 18: mod_base = um
  modified_base 19: mod_base = cm
  modified_base 20: mod_base = um
  modified_base 21: mod_base = OTHER; note = 2'-O-methyladenosine
  source 1..21: mol_type = other RNA
gatgaggatttgggttttcta

SEQ ID NO: 1142 - RNA, 21 nt, synthetic construct
  modified_base 1: mod_base = gm
  modified_base 2: mod_base = OTHER; note = 2'-O-methyladenosine
  modified_base 3: mod_base = um
  modified_base 4: mod_base = gm
  modified_base 5: mod_base = OTHER; note = 2'-O-methyladenosine
  modified_base 6: mod_base = gm
  modified_base 7: mod_base = gm
  modified_base 8: mod_base = OTHER; note = 2'-O-methyladenosine
  modified_base 9: mod_base = OTHER; note = 2'-deoxy-5-methyluridine
  modified_base 10: mod_base = um
  modified_base 11: mod_base = OTHER; note = 2'-fluorouridine
  modified_base 12: mod_base = gm
  modified_base 13: mod_base = gm
  modified_base 14: mod_base = gm
  modified_base 15: mod_base = um
  modified_base 16: mod_base = um
  modified_base 17: mod_base = um
  modified_base 18: mod_base = um
  modified_base 19: mod_base = cm
  modified_base 20: mod_base = um
  modified_base 21: mod_base = OTHER; note = 2'-O-methyladenosine
  source 1..21: mol_type = other RNA
gatgaggatttgggttttcta

SEQ ID NO: 1143 - RNA, 21 nt, synthetic construct
  modified_base 1: mod_base = gm
  modified_base 2: mod_base = OTHER; note = 2'-O-methyladenosine
  modified_base 3: mod_base = um
  modified_base 4: mod_base = gm
  modified_base 5: mod_base = OTHER; note = 2'-O-methyladenosine
  modified_base 6: mod_base = gm
  modified_base 7: mod_base = gm
  modified_base 8: mod_base = OTHER; note = 2'-O-methyladenosine
  modified_base 9: mod_base = OTHER; note = 2'-fluorouridine
  modified_base 10: mod_base = um
  modified_base 11: mod_base = OTHER; note = 2'-deoxy-5-methyluridine
  modified_base 12: mod_base = gm
  modified_base 13: mod_base = gm
  modified_base 14: mod_base = gm
  modified_base 15: mod_base = um
  modified_base 16: mod_base = um
  modified_base 17: mod_base = um
  modified_base 18: mod_base = um
  modified_base 19: mod_base = cm
  modified_base 20: mod_base = um
  modified_base 21: mod_base = OTHER; note = 2'-O-methyladenosine
  source 1..21: mol_type = other RNA
gatgaggatttgggttttcta

SEQ ID NO: 1144 - RNA, 21 nt, synthetic construct
  modified_base 1: mod_base = gm
  modified_base 2: mod_base = OTHER; note = 2'-O-methyladenosine
  modified_base 3: mod_base = um
  modified_base 4: mod_base = gm
  modified_base 5: mod_base = OTHER; note = 2'-O-methyladenosine
  modified_base 6: mod_base = gm
  modified_base 7: mod_base = gm
  modified_base 8: mod_base = OTHER; note = 2'-O-methyladenosine
  modified_base 9: mod_base = OTHER; note = 2'-deoxy-5-methyluridine
  modified_base 10: mod_base = um
  modified_base 11: mod_base = OTHER; note = 2'-deoxy-5-methyluridine
  modified_base 12: mod_base = gm
  modified_base 13: mod_base = gm
  modified_base 14: mod_base = gm
  modified_base 15: mod_base = um
  modified_base 16: mod_base = um
  modified_base 17: mod_base = um
  modified_base 18: mod_base = um
  modified_base 19: mod_base = cm
  modified_base 20: mod_base = um
  modified_base 21: mod_base = OTHER; note = 2'-O-methyladenosine
  source 1..21: mol_type = other RNA
gatgaggatttgggttttcta

SEQ ID NO: 1145 - RNA, 21 nt, synthetic construct
  modified_base 1: mod_base = gm
  modified_base 2: mod_base = OTHER; note = 2'-O-methyladenosine
  modified_base 3: mod_base = um
  modified_base 4: mod_base = gm
  modified_base 5: mod_base = OTHER; note = 2'-O-methyladenosine
  modified_base 6: mod_base = gm
  modified_base 7: mod_base = gm
  modified_base 8: mod_base = OTHER; note = 2'-O-methyladenosine
  modified_base 9: mod_base = OTHER; note = uridine
  modified_base 10: mod_base = um
  modified_base 11: mod_base = OTHER; note = 2'-deoxy-5-methyluridine
  modified_base 12: mod_base = gm
  modified_base 13: mod_base = gm
  modified_base 14: mod_base = gm
  modified_base 15: mod_base = um
  modified_base 16: mod_base = um
  modified_base 17: mod_base = um
  modified_base 18: mod_base = um
  modified_base 19: mod_base = cm
  modified_base 20: mod_base = um
  modified_base 21: mod_base = OTHER; note = 2'-O-methyladenosine
  source 1..21: mol_type = other RNA
gatgaggatttgggttttcta

SEQ ID NO: 1146 - RNA, 21 nt, synthetic construct
  modified_base 1: mod_base = gm
  modified_base 2: mod_base = OTHER; note = 2'-O-methyladenosine
  modified_base 3: mod_base = um
  modified_base 4: mod_base = gm
  modified_base 5: mod_base = OTHER; note = 2'-O-methyladenosine
  modified_base 6: mod_base = gm
  modified_base 7: mod_base = gm
  modified_base 8: mod_base = OTHER; note = 2'-O-methyladenosine
  modified_base 9: mod_base = OTHER; note = 2'-deoxy-5-methyluridine
  modified_base 10: mod_base = um
  modified_base 11: mod_base = OTHER; note = uridine
  modified_base 12: mod_base = gm
  modified_base 13: mod_base = gm
  modified_base 14: mod_base = gm
  modified_base 15: mod_base = um
  modified_base 16: mod_base = um
  modified_base 17: mod_base = um
  modified_base 18: mod_base = um
  modified_base 19: mod_base = cm
  modified_base 20: mod_base = um
  modified_base 21: mod_base = OTHER; note = 2'-O-methyladenosine
  source 1..21: mol_type = other RNA
gatgaggatttgggttttcta

SEQ ID NO: 1147 - RNA, 19 nt, synthetic construct
  modified_base 1: mod_base = um
  modified_base 2: mod_base = gm
  modified_base 3: mod_base = OTHER; note = 2'-O-methyladenosine
  modified_base 4: mod_base = gm
  modified_base 5: mod_base = gm
  modified_base 6: mod_base = OTHER; note = 2'-O-methyladenosine
  modified_base 7: mod_base = OTHER; note = 2'-fluorouridine
  modified_base 8: mod_base = um
  modified_base 9: mod_base = OTHER; note = 2'-fluorouridine
  modified_base 10: mod_base = OTHER; note = 2'-fluoroguanosine
  modified_base 11: mod_base = gm
  modified_base 12: mod_base = gm
  modified_base 13: mod_base = um
  modified_base 14: mod_base = um
  modified_base 15: mod_base = um
  modified_base 16: mod_base = um
  modified_base 17: mod_base = cm
  modified_base 18: mod_base = um
  modified_base 19: mod_base = OTHER; note = 2'-O-methyladenosine
  source 1..19: mol_type = other RNA
tgaggatttgggttttcta

SEQ ID NO: 1148 - RNA, 19 nt, synthetic construct
  modified_base 1: mod_base = um
  modified_base 1^2: mod_base = OTHER; note = phosphorothioate linkage
  modified_base 2: mod_base = gm
  modified_base 3: mod_base = OTHER; note = 2'-O-methyladenosine
  modified_base 4: mod_base = gm
  modified_base 5: mod_base = gm
  modified_base 6: mod_base = OTHER; note = 2'-O-methyladenosine
  modified_base 7: mod_base = OTHER; note = 2'-fluorouridine
  modified_base 8: mod_base = um
  modified_base 9: mod_base = OTHER; note = 2'-fluorouridine
  modified_base 10: mod_base = OTHER; note = 2'-fluoroguanosine
  modified_base 11: mod_base = gm
  modified_base 12: mod_base = gm
  modified_base 13: mod_base = um
  modified_base 14: mod_base = um
  modified_base 15: mod_base = um
  modified_base 16: mod_base = um
  modified_base 17: mod_base = cm
  modified_base 18: mod_base = um
  modified_base 19: mod_base = OTHER; note = 2'-O-methyladenosine
  source 1..19: mol_type = other RNA
tgaggatttgggttttcta

SEQ ID NO: 1149 - RNA, 21 nt, synthetic construct
  modified_base 1: mod_base = gm
  modified_base 2: mod_base = cm
  modified_base 3: mod_base = um
  modified_base 4: mod_base = gm
  modified_base 5: mod_base = um
  modified_base 6: mod_base = gm
  modified_base 7: mod_base = gm
  modified_base 8: mod_base = um
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluorouridine
  modified_base 12: mod_base = um
  modified_base 13: mod_base = gm
  modified_base 14: mod_base = OTHER; note = 2'-O-methyladenosine
  modified_base 15: mod_base = gm
  modified_base 16: mod_base = um
  modified_base 17: mod_base = OTHER; note = 2'-O-methyladenosine
  modified_base 18: mod_base = cm
  modified_base 19: mod_base = um
  modified_base 20: mod_base = um
  modified_base 21: mod_base = OTHER; note = 2'-O-methyladenosine
  source 1..21: mol_type = other RNA
gctgtggtgtttgagtactta

SEQ ID NO: 1150 - RNA, 21 nt, synthetic construct
  modified_base 1: mod_base = gm
  modified_base 2: mod_base = gm
  modified_base 3: mod_base = OTHER; note = 2'-O-methyladenosine
  modified_base 4: mod_base = cm
  modified_base 5: mod_base = cm
  modified_base 6: mod_base = cm
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = um
  modified_base 11: mod_base = OTHER; note = 2'-fluoroadenosine
  modified_base 12: mod_base = cm
  modified_base 13: mod_base = um
  modified_base 14: mod_base = gm
  modified_base 15: mod_base = um
  modified_base 16: mod_base = cm
  modified_base 17: mod_base = OTHER; note = 2'-O-methyladenosine
  modified_base 18: mod_base = um
  modified_base 19: mod_base = um
  modified_base 20: mod_base = gm
  modified_base 21: mod_base = OTHER; note = 2'-O-methyladenosine
  source 1..21: mol_type = other RNA
ggacccaattactgtcattga

SEQ ID NO: 1151 - RNA, 21 nt, synthetic construct
  modified_base 1: mod_base = gm
  modified_base 2: mod_base = gm
  modified_base 3: mod_base = OTHER; note = 2'-O-methyladenosine
  modified_base 4: mod_base = cm
  modified_base 5: mod_base = cm
  modified_base 6: mod_base = cm
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = um
  modified_base 11: mod_base = OTHER; note = 2'-fluoroadenosine
  modified_base 12: mod_base = OTHER; note = 2'-fluorocytidine
  modified_base 13: mod_base = um
  modified_base 14: mod_base = gm
  modified_base 15: mod_base = um
  modified_base 16: mod_base = cm
  modified_base 17: mod_base = OTHER; note = 2'-O-methyladenosine
  modified_base 18: mod_base = um
  modified_base 19: mod_base = um
  modified_base 20: mod_base = gm
  modified_base 21: mod_base = OTHER; note = 2'-O-methyladenosine
  source 1..21: mol_type = other RNA
ggacccaattactgtcattga

SEQ ID NO: 1152 - RNA, 21 nt, synthetic construct
  modified_base 1: mod_base = gm
  modified_base 2: mod_base = gm
  modified_base 3: mod_base = OTHER; note = 2'-O-methyladenosine
  modified_base 4: mod_base = cm
  modified_base 5: mod_base = cm
  modified_base 6: mod_base = cm
  modified_base 7: mod_base = OTHER; note = 2'-fluoroadenosine
  modified_base 8: mod_base = OTHER; note = 2'-O-methyladenosine
  modified_base 9: mod_base = OTHER; note = 2'-fluorouridine
  modified_base 10: mod_base = um
  modified_base 11: mod_base = OTHER; note = 2'-fluoroadenosine
  modified_base 12: mod_base = cm
  modified_base 13: mod_base = um
  modified_base 14: mod_base = gm
  modified_base 15: mod_base = um
  modified_base 16: mod_base = cm
  modified_base 17: mod_base = OTHER; note = 2'-O-methyladenosine
  modified_base 18: mod_base = um
  modified_base 19: mod_base = um
  modified_base 20: mod_base = gm
  modified_base 21: mod_base = OTHER; note = 2'-O-methyladenosine
  source 1..21: mol_type = other RNA
ggacccaattactgtcattga

SEQ ID NO: 1153 - RNA, 19 nt, synthetic construct
  modified_base 1: mod_base = um
  modified_base 2: mod_base = gm
  modified_base 3: mod_base = um
  modified_base 4: mod_base = gm
  modified_base 5: mod_base = gm
  modified_base 6: mod_base = um
  modified_base 7: mod_base = OTHER; note = 2'-fluoroguanosine
  modified_base 8: mod_base = OTHER; note = 2'-fluorouridine
  modified_base 9: mod_base = OTHER; note = 2'-fluorocytidine
  modified_base 10: mod_base = um
  modified_base 11: mod_base = gm
  modified_base 12: mod_base = OTHER; note = 2'-O-methyladenosine
  modified_base 13: mod_base = gm
  modified_base 14: mod_base = um
  modified_base 15: mod_base = OTHER; note = 2'-O-methyladenosine
  modified_base 16: mod_base = cm
  modified_base 17: mod_base = um
  modified_base 18: mod_base = um
  modified_base 19: mod_base = um
  source 1..19: mol_type = other RNA
tgtggtgtctgagtacttt

SEQ ID NO: 1154 - RNA, 19 nt, synthetic construct
  modified_base 1: mod_base = cm
  modified_base 2: mod_base = gm
  modified_base 3: mod_base = um
  modified_base 4: mod_base = gm
  modified_base 5: mod_base = gm
  modified_base 6: mod_base = um
  modified_base 7: mod_base = OTHER; note = 2'-fluoroguanosine
  modified_base 8: mod_base = OTHER; note = 2'-fluorouridine
  modified_base 9: mod_base = OTHER; note = 2'-fluorocytidine
  modified_base 10: mod_base = um
  modified_base 11: mod_base = gm
  modified_base 12: mod_base = OTHER; note = 2'-O-methyladenosine
  modified_base 13: mod_base = gm
  modified_base 14: mod_base = um
  modified_base 15: mod_base = OTHER; note = 2'-O-methyladenosine
  modified_base 16: mod_base = cm
  modified_base 17: mod_base = um
  modified_base 18: mod_base = um
  modified_base 19: mod_base = um
  source 1..19: mol_type = other RNA
cgtggtgtctgagtacttt

SEQ ID NO: 1155 - RNA, 19 nt, synthetic construct
  modified_base 1: mod_base = gm
  modified_base 2: mod_base = gm
  modified_base 3: mod_base = um
  modified_base 4: mod_base = gm
  modified_base 5: mod_base = gm
  modified_base 6: mod_base = um
  modified_base 7: mod_base = OTHER; note = 2'-fluoroguanosine
  modified_base 8: mod_base = OTHER; note = 2'-fluorouridine
  modified_base 9: mod_base = OTHER; note = 2'-fluorocytidine
  modified_base 10: mod_base = um
  modified_base 11: mod_base = gm
  modified_base 12: mod_base = OTHER; note = 2'-O-methyladenosine
  modified_base 13: mod_base = gm
  modified_base 14: mod_base = um
  modified_base 15: mod_base = OTHER; note = 2'-O-methyladenosine
  modified_base 16: mod_base = cm
  modified_base 17: mod_base = um
  modified_base 18: mod_base = um
  modified_base 19: mod_base = um
  source 1..19: mol_type = other RNA
ggtggtgtctgagtacttt

SEQ ID NO: 1156 - RNA, 21 nt, synthetic construct
  modified_base 1: mod_base = gm
  modified_base 2: mod_base = cm
  modified_base 3: mod_base = um
  modified_base 4: mod_base = gm
  modified_base 5: mod_base = um
  modified_base 6: mod_base = gm
  modified_base 7: mod_base = gm
  modified_base 8: mod_base = um
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = OTHER; note = 2'-O-methyladenosine
  modified_base 15: mod_base = gm
  modified_base 16: mod_base = um
  modified_base 17: mod_base = OTHER; note = 2'-O-methyladenosine
  modified_base 18: mod_base = cm
  modified_base 19: mod_base = um
  modified_base 20: mod_base = um
  modified_base 21: mod_base = OTHER; note = 2'-O-methyladenosine
  source 1..21: mol_type = other RNA
gctgtggtgtctgagtactta

SEQ ID NO: 1157 - RNA, 21 nt, synthetic construct
  modified_base 1: mod_base = gm
  modified_base 2: mod_base = gm
  modified_base 3: mod_base = um
  modified_base 4: mod_base = gm
  modified_base 5: mod_base = OTHER; note = 2'-O-methyladenosine
  modified_base 6: mod_base = gm
  modified_base 7: mod_base = OTHER; note = 2'-fluoroguanosine
  modified_base 8: mod_base = OTHER; note = 2'-O-methyladenosine
  modified_base 9: mod_base = OTHER; note = 2'-fluorouridine
  modified_base 10: mod_base = um
  modified_base 11: mod_base = OTHER; note = 2'-fluorouridine
  modified_base 12: mod_base = gm
  modified_base 13: mod_base = gm
  modified_base 14: mod_base = gm
  modified_base 15: mod_base = um
  modified_base 16: mod_base = um
  modified_base 17: mod_base = um
  modified_base 18: mod_base = um
  modified_base 19: mod_base = cm
  modified_base 20: mod_base = um
  modified_base 21: mod_base = OTHER; note = 2'-O-methyladenosine
  source 1..21: mol_type = other RNA
ggtgaggatttgggttttcta

SEQ ID NO: 1158 - RNA, 19 nt, synthetic construct
  modified_base 1: mod_base = gm
  modified_base 1^2: mod_base = OTHER; note = phosphorothioate linkage
  modified_base 2: mod_base = gm
  modified_base 3: mod_base = um
  modified_base 4: mod_base = gm
  modified_base 5: mod_base = gm
  modified_base 6: mod_base = um
  modified_base 7: mod_base = OTHER; note = 2'-fluoroguanosine
  modified_base 8: mod_base = OTHER; note = 2'-fluorouridine
  modified_base 9: mod_base = OTHER; note = 2'-fluorocytidine
  modified_base 10: mod_base = um
  modified_base 11: mod_base = gm
  modified_base 12: mod_base = OTHER; note = 2'-O-methyladenosine
  modified_base 13: mod_base = gm
  modified_base 14: mod_base = um
  modified_base 15: mod_base = OTHER; note = 2'-O-methyladenosine
  modified_base 16: mod_base = cm
  modified_base 17: mod_base = um
  modified_base 18: mod_base = um
  modified_base 19: mod_base = um
  source 1..19: mol_type = other RNA
ggtggtgtctgagtacttt

SEQ ID NO: 1159 - RNA, 19 nt, synthetic construct
  modified_base 1: mod_base = cm
  modified_base 1^2: mod_base = OTHER; note = phosphorothioate linkage
  modified_base 2: mod_base = gm
  modified_base 3: mod_base = um
  modified_base 4: mod_base = gm
  modified_base 5: mod_base = gm
  modified_base 6: mod_base = um
  modified_base 7: mod_base = OTHER; note = 2'-fluoroguanosine
  modified_base 8: mod_base = OTHER; note = 2'-fluorouridine
  modified_base 9: mod_base = OTHER; note = 2'-fluorocytidine
  modified_base 10: mod_base = um
  modified_base 11: mod_base = gm
  modified_base 12: mod_base = OTHER; note = 2'-O-methyladenosine
  modified_base 13: mod_base = gm
  modified_base 14: mod_base = um
  modified_base 15: mod_base = OTHER; note = 2'-O-methyladenosine
  modified_base 16: mod_base = cm
  modified_base 17: mod_base = um
  modified_base 18: mod_base = um
  modified_base 19: mod_base = um
  source 1..19: mol_type = other RNA
cgtggtgtctgagtacttt

SEQ ID NO: 1160 - RNA, 19 nt, synthetic construct
  modified_base 1: mod_base = um
  modified_base 1^2: mod_base = OTHER; note = phosphorothioate linkage
  modified_base 2: mod_base = gm
  modified_base 3: mod_base = um
  modified_base 4: mod_base = gm
  modified_base 5: mod_base = gm
  modified_base 6: mod_base = um
  modified_base 7: mod_base = OTHER; note = 2'-fluoroguanosine
  modified_base 8: mod_base = OTHER; note = 2'-fluorouridine
  modified_base 9: mod_base = OTHER; note = 2'-fluorocytidine
  modified_base 10: mod_base = um
  modified_base 11: mod_base = gm
  modified_base 12: mod_base = OTHER; note = 2'-O-methyladenosine
  modified_base 13: mod_base = gm
  modified_base 14: mod_base = um
  modified_base 15: mod_base = OTHER; note = 2'-O-methyladenosine
  modified_base 16: mod_base = cm
  modified_base 17: mod_base = um
  modified_base 18: mod_base = um
  modified_base 19: mod_base = um
  source 1..19: mol_type = other RNA
tgtggtgtctgagtacttt

SEQ ID NO: 1161 - RNA, 18 nt, synthetic construct
  modified_base 1: mod_base = gm
  modified_base 1^2: mod_base = OTHER; note = phosphorothioate linkage
  modified_base 2: mod_base = gm
  modified_base 3: mod_base = um
  modified_base 4: mod_base = gm
  modified_base 5: mod_base = gm
  modified_base 6: mod_base = um
  modified_base 7: mod_base = OTHER; note = 2'-fluoroguanosine
  modified_base 8: mod_base = OTHER; note = 2'-fluorouridine
  modified_base 9: mod_base = OTHER; note = 2'-fluorocytidine
  modified_base 10: mod_base = um
  modified_base 11: mod_base = gm
  modified_base 12: mod_base = OTHER; note = 2'-O-methyladenosine
  modified_base 13: mod_base = gm
  modified_base 14: mod_base = um
  modified_base 15: mod_base = OTHER; note = 2'-O-methyladenosine
  modified_base 16: mod_base = cm
  modified_base 17: mod_base = um
  modified_base 18: mod_base = um
  source 1..18: mol_type = other RNA
ggtggtgtctgagtactt

SEQ ID NO: 1162 - RNA, 19 nt, synthetic construct
  modified_base 1: mod_base = gm
  modified_base 2: mod_base = gm
  modified_base 3: mod_base = OTHER; note = 2'-O-methyladenosine
  modified_base 4: mod_base = gm
  modified_base 5: mod_base = gm
  modified_base 6: mod_base = OTHER; note = 2'-O-methyladenosine
  modified_base 7: mod_base = OTHER; note = 2'-fluorouridine
  modified_base 8: mod_base = um
  modified_base 9: mod_base = OTHER; note = 2'-fluorouridine
  modified_base 10: mod_base = OTHER; note = 2'-fluoroguanosine
  modified_base 11: mod_base = gm
  modified_base 12: mod_base = gm
  modified_base 13: mod_base = um
  modified_base 14: mod_base = um
  modified_base 15: mod_base = um
  modified_base 16: mod_base = um
  modified_base 17: mod_base = cm
  modified_base 18: mod_base = um
  modified_base 19: mod_base = OTHER; note = 2'-O-methyladenosine
  source 1..19: mol_type = other RNA
ggaggatttgggttttcta

SEQ ID NO: 1163 - RNA, 19 nt, synthetic construct
  modified_base 1: mod_base = cm
  modified_base 2: mod_base = gm
  modified_base 3: mod_base = OTHER; note = 2'-O-methyladenosine
  modified_base 4: mod_base = gm
  modified_base 5: mod_base = gm
  modified_base 6: mod_base = OTHER; note = 2'-O-methyladenosine
  modified_base 7: mod_base = OTHER; note = 2'-fluorouridine
  modified_base 8: mod_base = um
  modified_base 9: mod_base = OTHER; note = 2'-fluorouridine
  modified_base 10: mod_base = OTHER; note = 2'-fluoroguanosine
  modified_base 11: mod_base = gm
  modified_base 12: mod_base = gm
  modified_base 13: mod_base = um
  modified_base 14: mod_base = um
  modified_base 15: mod_base = um
  modified_base 16: mod_base = um
  modified_base 17: mod_base = cm
  modified_base 18: mod_base = um
  modified_base 19: mod_base = OTHER; note = 2'-O-methyladenosine
  source 1..19: mol_type = other RNA
cgaggatttgggttttcta

SEQ ID NO: 1164 - RNA, 21 nt, synthetic construct
  modified_base 1: mod_base = gm
  modified_base 2: mod_base = cm
  modified_base 3: mod_base = um
  modified_base 4: mod_base = gm
  modified_base 5: mod_base = um
  modified_base 6: mod_base = OTHER; note = 2'-O-methyladenosine
  modified_base 7: mod_base = gm
  modified_base 8: mod_base = um
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = OTHER; note = 2'-O-methyladenosine
  modified_base 15: mod_base = gm
  modified_base 16: mod_base = um
  modified_base 17: mod_base = OTHER; note = 2'-O-methyladenosine
  modified_base 18: mod_base = cm
  modified_base 19: mod_base = um
  modified_base 20: mod_base = um
  modified_base 21: mod_base = OTHER; note = 2'-O-methyladenosine
  source 1..21: mol_type = other RNA
gctgtagtgtctgagtactta

SEQ ID NO: 1165 - RNA, 21 nt, synthetic construct
  modified_base 1: mod_base = gm
  modified_base 2: mod_base = cm
  modified_base 3: mod_base = um
  modified_base 4: mod_base = OTHER; note = 2'-O-methyladenosine
  modified_base 5: mod_base = um
  modified_base 6: mod_base = gm
  modified_base 7: mod_base = gm
  modified_base 8: mod_base = um
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = OTHER; note = 2'-O-methyladenosine
  modified_base 15: mod_base = gm
  modified_base 16: mod_base = um
  modified_base 17: mod_base = OTHER; note = 2'-O-methyladenosine
  modified_base 18: mod_base = cm
  modified_base 19: mod_base = um
  modified_base 20: mod_base = um
  modified_base 21: mod_base = OTHER; note = 2'-O-methyladenosine
  source 1..21: mol_type = other RNA
gctatggtgtctgagtactta

SEQ ID NO: 1166 - RNA, 21 nt, synthetic construct
  modified_base 1: mod_base = gm
  modified_base 2: mod_base = cm
  modified_base 3: mod_base = um
  modified_base 4: mod_base = gm
  modified_base 5: mod_base = um
  modified_base 6: mod_base = gm
  modified_base 7: mod_base = gm
  modified_base 8: mod_base = um
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluoroguanosine
  modified_base 12: mod_base = um
  modified_base 13: mod_base = gm
  modified_base 14: mod_base = OTHER; note = 2'-O-methyladenosine
  modified_base 15: mod_base = gm
  modified_base 16: mod_base = um
  modified_base 17: mod_base = OTHER; note = 2'-O-methyladenosine
  modified_base 18: mod_base = cm
  modified_base 19: mod_base = um
  modified_base 20: mod_base = um
  modified_base 21: mod_base = OTHER; note = 2'-O-methyladenosine
  source 1..21: mol_type = other RNA
gctgtggtgtgtgagtactta

SEQ ID NO: 1167 - RNA, 21 nt, synthetic construct
  modified_base 1: mod_base = gm
  modified_base 2: mod_base = cm
  modified_base 3: mod_base = um
  modified_base 4: mod_base = gm
  modified_base 5: mod_base = um
  modified_base 6: mod_base = um
  modified_base 7: mod_base = gm
  modified_base 8: mod_base = um
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluoroguanosine
  modified_base 12: mod_base = um
  modified_base 13: mod_base = gm
  modified_base 14: mod_base = OTHER; note = 2'-O-methyladenosine
  modified_base 15: mod_base = gm
  modified_base 16: mod_base = gm
  modified_base 17: mod_base = OTHER; note = 2'-O-methyladenosine
  modified_base 18: mod_base = cm
  modified_base 19: mod_base = um
  modified_base 20: mod_base = um
  modified_base 21: mod_base = OTHER; note = 2'-O-methyladenosine
  source 1..21: mol_type = other RNA
gctgttgtgtgtgaggactta

SEQ ID NO: 1168 - RNA, 21 nt, synthetic construct
  modified_base 1: mod_base = gm
  modified_base 2: mod_base = cm
  modified_base 3: mod_base = OTHER; note = 2'-O-methyladenosine
  modified_base 4: mod_base = um
  modified_base 5: mod_base = cm
  modified_base 6: mod_base = um
  modified_base 7: mod_base = OTHER; note = 2'-O-methyladenosine
  modified_base 8: mod_base = cm
  modified_base 9: mod_base = OTHER; note = 2'-fluorocytidine
  modified_base 10: mod_base = OTHER; note = 2'-fluorouridine
  modified_base 11: mod_base = OTHER; note = 2'-fluoroguanosine
  modified_base 12: mod_base = gm
  modified_base 13: mod_base = um
  modified_base 14: mod_base = gm
  modified_base 15: mod_base = cm
  modified_base 16: mod_base = um
  modified_base 17: mod_base = OTHER; note = 2'-O-methyladenosine
  modified_base 18: mod_base = gm
  modified_base 19: mod_base = OTHER; note = 2'-O-methyladenosine
  modified_base 20: mod_base = um
  modified_base 21: mod_base = OTHER; note = 2'-O-methyladenosine
  source 1..21: mol_type = other RNA
gcatctacctggtgctagata

SEQ ID NO: 1169 - RNA, 21 nt, synthetic construct
  modified_base 1: mod_base = cm
  modified_base 2: mod_base = OTHER; note = 2'-O-methyladenosine
  modified_base 3: mod_base = um
  modified_base 4: mod_base = cm
  modified_base 5: mod_base = um
  modified_base 6: mod_base = OTHER; note = 2'-O-methyladenosine
  modified_base 7: mod_base = cm
  modified_base 8: mod_base = cm
  modified_base 9: mod_base = OTHER; note = 2'-fluorouridine
  modified_base 10: mod_base = OTHER; note = 2'-fluoroguanosine
  modified_base 11: mod_base = OTHER; note = 2'-fluoroguanosine
  modified_base 12: mod_base = um
  modified_base 13: mod_base = gm
  modified_base 14: mod_base = cm
  modified_base 15: mod_base = um
  modified_base 16: mod_base = OTHER; note = 2'-O-methyladenosine
  modified_base 17: mod_base = gm
  modified_base 18: mod_base = OTHER; note = 2'-O-methyladenosine
  modified_base 19: mod_base = um
  modified_base 20: mod_base = gm
  modified_base 21: mod_base = OTHER; note = 2'-O-methyladenosine
  source 1..21: mol_type = other RNA
catctacctggtgctagatga

SEQ ID NO: 1170 - RNA, 21 nt, synthetic construct
  modified_base 1: mod_base = OTHER; note = 2'-O-methyladenosine
  modified_base 2: mod_base = um
  modified_base 3: mod_base = cm
  modified_base 4: mod_base = um
  modified_base 5: mod_base = OTHER; note = 2'-O-methyladenosine
  modified_base 6: mod_base = cm
  modified_base 7: mod_base = cm
  modified_base 8: mod_base = um
  modified_base 9: mod_base = OTHER; note = 2'-fluoroguanosine
  modified_base 10: mod_base = OTHER; note = 2'-fluoroguanosine
  modified_base 11: mod_base = OTHER; note = 2'-fluorouridine
  modified_base 12: mod_base = gm
  modified_base 13: mod_base = cm
  modified_base 14: mod_base = um
  modified_base 15: mod_base = OTHER; note = 2'-O-methyladenosine
  modified_base 16: mod_base = gm
  modified_base 17: mod_base = OTHER; note = 2'-O-methyladenosine
  modified_base 18: mod_base = um
  modified_base 19: mod_base = OTHER; note = 2'-O-methylinosine
  modified_base 20: mod_base = gm
  modified_base 21: mod_base = OTHER; note = 2'-O-methyladenosine
  source 1..21: mol_type = other RNA
atctacctggtgctagatnga

SEQ ID NO: 1171 - RNA, 21 nt, synthetic construct
  modified_base 1: mod_base = um
  modified_base 2: mod_base = cm
  modified_base 3: mod_base = um
  modified_base 4: mod_base = OTHER; note = 2'-O-methyladenosine
  modified_base 5: mod_base = cm
  modified_base 6: mod_base = cm
  modified_base 7: mod_base = um
  modified_base 8: mod_base = gm
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluoroguanosine
  modified_base 12: mod_base = cm
  modified_base 13: mod_base = um
  modified_base 14: mod_base = OTHER; note = 2'-O-methyladenosine
  modified_base 15: mod_base = gm
  modified_base 16: mod_base = OTHER; note = 2'-O-methyladenosine
  modified_base 17: mod_base = um
  modified_base 18: mod_base = OTHER; note = 2'-O-methylinosine
  modified_base 19: mod_base = gm
  modified_base 20: mod_base = OTHER; note = 2'-O-methyladenosine
  modified_base 21: mod_base = um
  source 1..21: mol_type = other RNA
tctacctggtgctagatngat

SEQ ID NO: 1172 - RNA, 21 nt, synthetic construct
  modified_base 1: mod_base = um
  modified_base 2: mod_base = OTHER; note = 2'-O-methyladenosine
  modified_base 3: mod_base = cm
  modified_base 4: mod_base = cm
  modified_base 5: mod_base = um
  modified_base 6: mod_base = gm
  modified_base 7: mod_base = gm
  modified_base 8: mod_base = um
  modified_base 9: mod_base = OTHER; note = 2'-fluoroguanosine
  modified_base 10: mod_base = OTHER; note = 2'-fluorocytidine
  modified_base 11: mod_base = OTHER; note = 2'-fluorouridine
  modified_base 12: mod_base = OTHER; note = 2'-O-methyladenosine
  modified_base 13: mod_base = gm
  modified_base 14: mod_base = OTHER; note = 2'-O-methyladenosine
  modified_base 15: mod_base = um
  modified_base 16: mod_base = gm
  modified_base 17: mod_base = OTHER; note = 2'-O-methylinosine
  modified_base 18: mod_base = OTHER; note = 2'-O-methyladenosine
  modified_base 19: mod_base = um
  modified_base 20: mod_base = cm
  modified_base 21: mod_base = OTHER; note = 2'-O-methyladenosine
  source 1..21: mol_type = other RNA
tacctggtgctagatgnatca

SEQ ID NO: 1173 - RNA, 21 nt, synthetic construct
  modified_base 1: mod_base = um
  modified_base 2: mod_base = gm
  modified_base 3: mod_base = gm
  modified_base 4: mod_base = um
  modified_base 5: mod_base = gm
  modified_base 6: mod_base = cm
  modified_base 7: mod_base = um
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluorouridine
  modified_base 12: mod_base = gm
  modified_base 13: mod_base = gm
  modified_base 14: mod_base = OTHER; note = 2'-O-methyladenosine
  modified_base 15: mod_base = um
  modified_base 16: mod_base = cm
  modified_base 17: mod_base = OTHER; note = 2'-O-methyladenosine
  modified_base 18: mod_base = OTHER; note = 2'-O-methylinosine
  modified_base 19: mod_base = OTHER; note = 2'-O-methyladenosine
  modified_base 20: mod_base = cm
  modified_base 21: mod_base = OTHER; note = 2'-O-methyladenosine
  source 1..21: mol_type = other RNA
tggtgctagatggatcanaca

SEQ ID NO: 1174 - RNA, 21 nt, synthetic construct
  modified_base 1: mod_base = gm
  modified_base 2: mod_base = cm
  modified_base 3: mod_base = um
  modified_base 4: mod_base = OTHER; note = 2'-O-methyladenosine
  modified_base 5: mod_base = gm
  modified_base 6: mod_base = OTHER; note = 2'-O-methyladenosine
  modified_base 7: mod_base = um
  modified_base 8: mod_base = gm
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluorouridine
  modified_base 12: mod_base = cm
  modified_base 13: mod_base = OTHER; note = 2'-O-methyladenosine
  modified_base 14: mod_base = gm
  modified_base 15: mod_base = OTHER; note = 2'-O-methyladenosine
  modified_base 16: mod_base = cm
  modified_base 17: mod_base = OTHER; note = 2'-O-methyladenosine
  modified_base 18: mod_base = OTHER; note = 2'-O-methylinosine
  modified_base 19: mod_base = cm
  modified_base 20: mod_base = OTHER; note = 2'-O-methyladenosine
  modified_base 21: mod_base = um
  source 1..21: mol_type = other RNA
gctagatggatcagacancat

SEQ ID NO: 1175 - RNA, 21 nt, synthetic construct
  modified_base 1: mod_base = um
  modified_base 2: mod_base = cm
  modified_base 3: mod_base = um
  modified_base 4: mod_base = cm
  modified_base 5: mod_base = um
  modified_base 6: mod_base = gm
  modified_base 7: mod_base = OTHER; note = 2'-O-methyladenosine
  modified_base 8: mod_base = gm
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorouridine
  modified_base 12: mod_base = cm
  modified_base 13: mod_base = um
  modified_base 14: mod_base = gm
  modified_base 15: mod_base = um
  modified_base 16: mod_base = gm
  modified_base 17: mod_base = OTHER; note = 2'-O-methylinosine
  modified_base 18: mod_base = cm
  modified_base 19: mod_base = OTHER; note = 2'-O-methyladenosine
  modified_base 20: mod_base = um
  modified_base 21: mod_base = OTHER; note = 2'-O-methyladenosine
  source 1..21: mol_type = other RNA
tctctgagtctctgtgncata

SEQ ID NO: 1176 - RNA, 21 nt, synthetic construct
  modified_base 1: mod_base = gm
  modified_base 2: mod_base = cm
  modified_base 3: mod_base = um
  modified_base 4: mod_base = gm
  modified_base 5: mod_base = um
  modified_base 6: mod_base = gm
  modified_base 7: mod_base = gm
  modified_base 8: mod_base = um
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = OTHER; note = 2'-O-methyladenosine
  modified_base 15: mod_base = gm
  modified_base 16: mod_base = um
  modified_base 17: mod_base = OTHER; note = 2'-O-methyladenosine
  modified_base 18: mod_base = cm
  modified_base 19: mod_base = um
  modified_base 20: mod_base = um
  modified_base 21: mod_base = um
  source 1..21: mol_type = other RNA
gctgtggtgtctgagtacttt

SEQ ID NO: 1177 - RNA, 21 nt, synthetic construct
  modified_base 1: mod_base = cm
  modified_base 2: mod_base = gm
  modified_base 3: mod_base = um
  modified_base 4: mod_base = um
  modified_base 5: mod_base = um
  modified_base 6: mod_base = cm
  modified_base 7: mod_base = OTHER; note = 2'-O-methyladenosine
  modified_base 8: mod_base = um
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluoroadenosine
  modified_base 12: mod_base = OTHER; note = 2'-O-methyladenosine
  modified_base 13: mod_base = gm
  modified_base 14: mod_base = um
  modified_base 15: mod_base = um
  modified_base 16: mod_base = gm
  modified_base 17: mod_base = OTHER; note = 2'-O-methylinosine
  modified_base 18: mod_base = um
  modified_base 19: mod_base = gm
  modified_base 20: mod_base = um
  modified_base 21: mod_base = OTHER; note = 2'-O-methyladenosine
  source 1..21: mol_type = other RNA
cgtttcattcaagttgntgta

SEQ ID NO: 1178 - RNA, 21 nt, synthetic construct
  modified_base 1: mod_base = gm
  modified_base 2: mod_base = um
  modified_base 3: mod_base = OTHER; note = 2'-O-methyl-2-aminoadenosine
  modified_base 4: mod_base = OTHER; note = 2'-O-methyladenosine
  modified_base 5: mod_base = um
  modified_base 6: mod_base = cm
  modified_base 7: mod_base = OTHER; note = 2'-O-methyladenosine
  modified_base 8: mod_base = gm
  modified_base 9: mod_base = OTHER; note = 2'-fluorocytidine
  modified_base 10: mod_base = OTHER; note = 2'-fluorouridine
  modified_base 11: mod_base = OTHER; note = 2'-fluoroguanosine
  modified_base 12: mod_base = gm
  modified_base 13: mod_base = gm
  modified_base 14: mod_base = gm
  modified_base 15: mod_base = OTHER; note = 2'-O-methyladenosine
  modified_base 16: mod_base = gm
  modified_base 17: mod_base = um
  modified_base 18: mod_base = OTHER; note = 2'-O-methyladenosine
  modified_base 19: mod_base = gm
  modified_base 20: mod_base = um
  modified_base 21: mod_base = OTHER; note = 2'-O-methyladenosine
  source 1..21: mol_type = other RNA
gtnatcagctggggagtagta

SEQ ID NO: 1179 - RNA, 21 nt, synthetic construct
  modified_base 1: mod_base = gm
  modified_base 2: mod_base = OTHER; note = 2'-O-methyladenosine
  modified_base 3: mod_base = um
  modified_base 4: mod_base = cm
  modified_base 5: mod_base = OTHER; note = 2'-O-methyladenosine
  modified_base 6: mod_base = gm
  modified_base 7: mod_base = cm
  modified_base 8: mod_base = um
  modified_base 9: mod_base = OTHER; note = 2'-fluoroguanosine
  modified_base 10: mod_base = OTHER; note = 2'-fluoroguanosine
  modified_base 11: mod_base = OTHER; note = 2'-fluoroguanosine
  modified_base 12: mod_base = gm
  modified_base 13: mod_base = OTHER; note = 2'-O-methyladenosine
  modified_base 14: mod_base = gm
  modified_base 15: mod_base = um
  modified_base 16: mod_base = OTHER; note = 2'-O-methyladenosine
  modified_base 17: mod_base = gm
  modified_base 18: mod_base = um
  modified_base 19: mod_base = OTHER; note = 2'-O-methylinosine
  modified_base 20: mod_base = gm
  modified_base 21: mod_base = OTHER; note = 2'-O-methyladenosine
  source 1..21: mol_type = other RNA
gatcagctggggagtagtnga

SEQ ID NO: 1180 - RNA, 21 nt, synthetic construct
  modified_base 1: mod_base = OTHER; note = 2'-O-methyladenosine
  modified_base 2: mod_base = gm
  modified_base 3: mod_base = cm
  modified_base 4: mod_base = um
  modified_base 5: mod_base = gm
  modified_base 6: mod_base = gm
  modified_base 7: mod_base = gm
  modified_base 8: mod_base = gm
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluorouridine
  modified_base 12: mod_base = OTHER; note = 2'-O-methyladenosine
  modified_base 13: mod_base = gm
  modified_base 14: mod_base = um
  modified_base 15: mod_base = gm
  modified_base 16: mod_base = OTHER; note = 2'-O-methylinosine
  modified_base 17: mod_base = OTHER; note = 2'-O-methyladenosine
  modified_base 18: mod_base = um
  modified_base 19: mod_base = gm
  modified_base 20: mod_base = um
  modified_base 21: mod_base = OTHER; note = 2'-O-methyladenosine
  source 1..21: mol_type = other RNA
agctggggagtagtgnatgta

SEQ ID NO: 1181 - RNA, 21 nt, synthetic construct
  modified_base 1: mod_base = cm
  modified_base 2: mod_base = um
  modified_base 3: mod_base = gm
  modified_base 4: mod_base = gm
  modified_base 5: mod_base = gm
  modified_base 6: mod_base = gm
  modified_base 7: mod_base = OTHER; note = 2'-O-methyladenosine
  modified_base 8: mod_base = gm
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluoroguanosine
  modified_base 12: mod_base = um
  modified_base 13: mod_base = gm
  modified_base 14: mod_base = gm
  modified_base 15: mod_base = OTHER; note = 2'-O-methyladenosine
  modified_base 16: mod_base = um
  modified_base 17: mod_base = gm
  modified_base 18: mod_base = um
  modified_base 19: mod_base = cm
  modified_base 20: mod_base = um
  modified_base 21: mod_base = OTHER; note = 2'-O-methyladenosine
  source 1..21: mol_type = other RNA
ctggggagtagtggatgtcta

SEQ ID NO: 1182 - RNA, 21 nt, synthetic construct
  modified_base 1: mod_base = um
  modified_base 2: mod_base = cm
  modified_base 3: mod_base = cm
  modified_base 4: mod_base = OTHER; note = 2'-O-methyladenosine
  modified_base 5: mod_base = OTHER; note = 2'-O-methyladenosine
  modified_base 6: mod_base = gm
  modified_base 7: mod_base = OTHER; note = 2'-O-methyladenosine
  modified_base 8: mod_base = um
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluoroguanosine
  modified_base 12: mod_base = gm
  modified_base 13: mod_base = OTHER; note = 2'-O-methyladenosine
  modified_base 14: mod_base = um
  modified_base 15: mod_base = um
  modified_base 16: mod_base = um
  modified_base 17: mod_base = gm
  modified_base 18: mod_base = OTHER; note = 2'-O-methylinosine
  modified_base 19: mod_base = gm
  modified_base 20: mod_base = um
  modified_base 21: mod_base = um
  source 1..21: mol_type = other RNA
tccaagatgaggatttgngtt

SEQ ID NO: 1183 - RNA, 21 nt, synthetic construct
  modified_base 1: mod_base = cm
  modified_base 2: mod_base = cm
  modified_base 3: mod_base = OTHER; note = 2'-O-methyladenosine
  modified_base 4: mod_base = OTHER; note = 2'-O-methyladenosine
  modified_base 5: mod_base = gm
  modified_base 6: mod_base = OTHER; note = 2'-O-methyladenosine
  modified_base 7: mod_base = um
  modified_base 8: mod_base = gm
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluoroguanosine
  modified_base 12: mod_base = OTHER; note = 2'-O-methyladenosine
  modified_base 13: mod_base = um
  modified_base 14: mod_base = um
  modified_base 15: mod_base = um
  modified_base 16: mod_base = gm
  modified_base 17: mod_base = OTHER; note = 2'-O-methylinosine
  modified_base 18: mod_base = gm
  modified_base 19: mod_base = um
  modified_base 20: mod_base = um
  modified_base 21: mod_base = um
  source 1..21: mol_type = other RNA
ccaagatgaggatttgngttt

SEQ ID NO: 1184 - RNA, 21 nt, synthetic construct
  modified_base 1: mod_base = gm
  modified_base 2: mod_base = OTHER; note = 2'-O-methyladenosine
  modified_base 3: mod_base = um
  modified_base 4: mod_base = gm
  modified_base 5: mod_base = OTHER; note = 2'-O-methyladenosine
  modified_base 6: mod_base = gm
  modified_base 7: mod_base = gm
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorouridine
  modified_base 11: mod_base = OTHER; note = 2'-fluorouridine
  modified_base 12: mod_base = gm
  modified_base 13: mod_base = gm
  modified_base 14: mod_base = gm
  modified_base 15: mod_base = um
  modified_base 16: mod_base = um
  modified_base 17: mod_base = um
  modified_base 18: mod_base = um
  modified_base 19: mod_base = cm
  modified_base 20: mod_base = um
  modified_base 21: mod_base = OTHER; note = 2'-O-methyladenosine
  source 1..21: mol_type = other RNA
gatgaggatttgggttttcta

SEQ ID NO: 1185 - RNA, 21 nt, synthetic construct
  modified_base 1: mod_base = gm
  modified_base 2: mod_base = OTHER; note = 2'-O-methyladenosine
  modified_base 3: mod_base = um
  modified_base 4: mod_base = gm
  modified_base 5: mod_base = OTHER; note = 2'-O-methyladenosine
  modified_base 6: mod_base = gm
  modified_base 7: mod_base = gm
  modified_base 8: mod_base = OTHER; note = 2'-O-methyladenosine
  modified_base 9: mod_base = OTHER; note = 2'-fluorouridine
  modified_base 10: mod_base = um
  modified_base 11: mod_base = OTHER; note = 2'-fluorouridine
  modified_base 12: mod_base = OTHER; note = 2'-fluoroguanosine
  modified_base 13: mod_base = gm
  modified_base 14: mod_base = gm
  modified_base 15: mod_base = um
  modified_base 16: mod_base = um
  modified_base 17: mod_base = um
  modified_base 18: mod_base = um
  modified_base 19: mod_base = cm
  modified_base 20: mod_base = um
  modified_base 21: mod_base = OTHER; note = 2'-O-methyladenosine
  source 1..21: mol_type = other RNA
gatgaggatttgggttttcta

SEQ ID NO: 1186 - RNA, 21 nt, synthetic construct
  modified_base 1: mod_base = gm
  modified_base 2: mod_base = OTHER; note = 2'-O-methyladenosine
  modified_base 3: mod_base = um
  modified_base 4: mod_base = gm
  modified_base 5: mod_base = OTHER; note = 2'-O-methyladenosine
  modified_base 6: mod_base = gm
  modified_base 7: mod_base = gm
  modified_base 8: mod_base = OTHER; note = 2'-O-methyladenosine
  modified_base 9: mod_base = OTHER; note = 2'-fluorouridine
  modified_base 10: mod_base = um
  modified_base 11: mod_base = OTHER; note = 2'-fluorouridine
  modified_base 12: mod_base = gm
  modified_base 13: mod_base = OTHER; note = 2'-fluoroguanosine
  modified_base 14: mod_base = gm
  modified_base 15: mod_base = um
  modified_base 16: mod_base = um
  modified_base 17: mod_base = um
  modified_base 18: mod_base = um
  modified_base 19: mod_base = cm
  modified_base 20: mod_base = um
  modified_base 21: mod_base = OTHER; note = 2'-O-methyladenosine
  source 1..21: mol_type = other RNA
gatgaggatttgggttttcta

SEQ ID NO: 1187 - RNA, 21 nt, synthetic construct
  modified_base 1: mod_base = gm
  modified_base 2: mod_base = OTHER; note = 2'-O-methyladenosine
  modified_base 3: mod_base = um
  modified_base 4: mod_base = gm
  modified_base 5: mod_base = OTHER; note = 2'-O-methyladenosine
  modified_base 6: mod_base = gm
  modified_base 7: mod_base = OTHER; note = 2'-fluoroguanosine
  modified_base 8: mod_base = OTHER; note = 2'-O-methyladenosine
  modified_base 9: mod_base = OTHER; note = 2'-fluorouridine
  modified_base 10: mod_base = um
  modified_base 11: mod_base = OTHER; note = 2'-fluorouridine
  modified_base 12: mod_base = gm
  modified_base 13: mod_base = gm
  modified_base 14: mod_base = gm
  modified_base 15: mod_base = um
  modified_base 16: mod_base = um
  modified_base 17: mod_base = um
  modified_base 18: mod_base = um
  modified_base 19: mod_base = cm
  modified_base 20: mod_base = um
  modified_base 21: mod_base = OTHER; note = 2'-O-methyladenosine
  source 1..21: mol_type = other RNA
gatgaggatttgggttttcta

SEQ ID NO: 1188 - RNA, 21 nt, synthetic construct
  modified_base 1: mod_base = cm
  modified_base 2: mod_base = OTHER; note = 2'-O-methyladenosine
  modified_base 3: mod_base = cm
  modified_base 4: mod_base = um
  modified_base 5: mod_base = gm
  modified_base 6: mod_base = cm
  modified_base 7: mod_base = um
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluoroguanosine
  modified_base 11: mod_base = OTHER; note = 2'-fluoroadenosine
  modified_base 12: mod_base = cm
  modified_base 13: mod_base = gm
  modified_base 14: mod_base = gm
  modified_base 15: mod_base = um
  modified_base 16: mod_base = um
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = cm
  modified_base 21: mod_base = um
  source 1..21: mol_type = other RNA
cactgctatgacggttacact

SEQ ID NO: 1189 - RNA, 21 nt, synthetic construct
  modified_base 1: mod_base = gm
  modified_base 2: mod_base = cm
  modified_base 3: mod_base = cm
  modified_base 4: mod_base = OTHER; note = 2'-O-methyladenosine
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluoroguanosine
  modified_base 12: mod_base = um
  modified_base 13: mod_base = cm
  modified_base 14: mod_base = um
  modified_base 15: mod_base = OTHER; note = 2'-O-methyladenosine
  modified_base 16: mod_base = gm
  modified_base 17: mod_base = um
  modified_base 18: mod_base = cm
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
gccaaaaagtgtctagtcaaa

SEQ ID NO: 1190 - RNA, 21 nt, synthetic construct
  modified_base 1: mod_base = cm
  modified_base 2: mod_base = OTHER; note = 2'-O-methyl-2-aminoadenosine
  modified_base 3: mod_base = OTHER; note = 2'-O-methyladenosine
  modified_base 4: mod_base = OTHER; note = 2'-O-methyladenosine
  modified_base 5: mod_base = OTHER; note = 2'-O-methyladenosine
  modified_base 6: mod_base = OTHER; note = 2'-O-methyladenosine
  modified_base 7: mod_base = gm
  modified_base 8: mod_base = um
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = OTHER; note = 2'-O-methyladenosine
  modified_base 14: mod_base = gm
  modified_base 15: mod_base = um
  modified_base 16: mod_base = cm
  modified_base 17: mod_base = OTHER; note = 2'-O-methyladenosine
  modified_base 18: mod_base = OTHER; note = 2'-O-methyladenosine
  modified_base 19: mod_base = cm
  modified_base 20: mod_base = um
  modified_base 21: mod_base = um
  source 1..21: mol_type = other RNA
cnaaaagtgtctagtcaactt

SEQ ID NO: 1191 - RNA, 21 nt, synthetic construct
  modified_base 1: mod_base = OTHER; note = 2'-O-methyladenosine
  modified_base 2: mod_base = gm
  modified_base 3: mod_base = OTHER; note = 2'-O-methyladenosine
  modified_base 4: mod_base = OTHER; note = 2'-O-methyladenosine
  modified_base 5: mod_base = gm
  modified_base 6: mod_base = gm
  modified_base 7: mod_base = um
  modified_base 8: mod_base = gm
  modified_base 9: mod_base = OTHER; note = 2'-fluoroguanosine
  modified_base 10: mod_base = OTHER; note = 2'-fluorocytidine
  modified_base 11: mod_base = OTHER; note = 2'-fluoroadenosine
  modified_base 12: mod_base = OTHER; note = 2'-O-methyladenosine
  modified_base 13: mod_base = gm
  modified_base 14: mod_base = um
  modified_base 15: mod_base = um
  modified_base 16: mod_base = OTHER; note = 2'-O-methyladenosine
  modified_base 17: mod_base = um
  modified_base 18: mod_base = gm
  modified_base 19: mod_base = gm
  modified_base 20: mod_base = um
  modified_base 21: mod_base = OTHER; note = 2'-O-methyladenosine
  source 1..21: mol_type = other RNA
agaaggtggcaagttatggta

SEQ ID NO: 1192 - RNA, 21 nt, synthetic construct
  modified_base 1: mod_base = cm
  modified_base 2: mod_base = um
  modified_base 3: mod_base = gm
  modified_base 4: mod_base = OTHER; note = 2'-O-methyladenosine
  modified_base 5: mod_base = um
  modified_base 6: mod_base = gm
  modified_base 7: mod_base = gm
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorouridine
  modified_base 11: mod_base = OTHER; note = 2'-fluoroguanosine
  modified_base 12: mod_base = cm
  modified_base 13: mod_base = OTHER; note = 2'-O-methyladenosine
  modified_base 14: mod_base = cm
  modified_base 15: mod_base = OTHER; note = 2'-O-methyladenosine
  modified_base 16: mod_base = OTHER; note = 2'-O-methyladenosine
  modified_base 17: mod_base = cm
  modified_base 18: mod_base = OTHER; note = 2'-O-methyladenosine
  modified_base 19: mod_base = um
  modified_base 20: mod_base = gm
  modified_base 21: mod_base = OTHER; note = 2'-O-methyladenosine
  source 1..21: mol_type = other RNA
ctgatggattgcacaacatga

SEQ ID NO: 1193 - RNA, 21 nt, synthetic construct
  modified_base 1: mod_base = cm
  modified_base 2: mod_base = cm
  modified_base 3: mod_base = cm
  modified_base 4: mod_base = OTHER; note = 2'-O-methyladenosine
  modified_base 5: mod_base = OTHER; note = 2'-O-methyladenosine
  modified_base 6: mod_base = um
  modified_base 7: mod_base = um
  modified_base 8: mod_base = OTHER; note = 2'-O-methyladenosine
  modified_base 9: mod_base = OTHER; note = 2'-fluorocytidine
  modified_base 10: mod_base = OTHER; note = 2'-fluorouridine
  modified_base 11: mod_base = OTHER; note = 2'-fluoroguanosine
  modified_base 12: mod_base = um
  modified_base 13: mod_base = cm
  modified_base 14: mod_base = OTHER; note = 2'-O-methyladenosine
  modified_base 15: mod_base = um
  modified_base 16: mod_base = um
  modified_base 17: mod_base = gm
  modified_base 18: mod_base = OTHER; note = 2'-O-methyladenosine
  modified_base 19: mod_base = um
  modified_base 20: mod_base = gm
  modified_base 21: mod_base = OTHER; note = 2'-O-methyladenosine
  source 1..21: mol_type = other RNA
cccaattactgtcattgatga

SEQ ID NO: 1194 - RNA, 21 nt, synthetic construct
  modified_base 1: mod_base = gm
  modified_base 2: mod_base = OTHER; note = 2'-O-methyladenosine
  modified_base 3: mod_base = OTHER; note = 2'-O-methyladenosine
  modified_base 4: mod_base = cm
  modified_base 5: mod_base = cm
  modified_base 6: mod_base = OTHER; note = 2'-O-methyladenosine
  modified_base 7: mod_base = OTHER; note = 2'-O-methyladenosine
  modified_base 8: mod_base = gm
  modified_base 9: mod_base = OTHER; note = 2'-fluorouridine
  modified_base 10: mod_base = OTHER; note = 2'-fluoroguanosine
  modified_base 11: mod_base = OTHER; note = 2'-fluoroadenosine
  modified_base 12: mod_base = OTHER; note = 2'-O-methyladenosine
  modified_base 13: mod_base = cm
  modified_base 14: mod_base = OTHER; note = 2'-O-methyladenosine
  modified_base 15: mod_base = um
  modified_base 16: mod_base = cm
  modified_base 17: mod_base = OTHER; note = 2'-O-methyladenosine
  modified_base 18: mod_base = OTHER; note = 2'-O-methyladenosine
  modified_base 19: mod_base = um
  modified_base 20: mod_base = gm
  modified_base 21: mod_base = OTHER; note = 2'-O-methyladenosine
  source 1..21: mol_type = other RNA
gaaccaagtgaacatcaatga

SEQ ID NO: 1195 - RNA, 21 nt, synthetic construct
  modified_base 1: mod_base = gm
  modified_base 2: mod_base = gm
  modified_base 3: mod_base = um
  modified_base 4: mod_base = OTHER; note = 2'-O-methyladenosine
  modified_base 5: mod_base = cm
  modified_base 6: mod_base = cm
  modified_base 7: mod_base = gm
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorouridine
  modified_base 11: mod_base = OTHER; note = 2'-fluoroadenosine
  modified_base 12: mod_base = cm
  modified_base 13: mod_base = cm
  modified_base 14: mod_base = OTHER; note = 2'-O-methyladenosine
  modified_base 15: mod_base = cm
  modified_base 16: mod_base = OTHER; note = 2'-O-methyladenosine
  modified_base 17: mod_base = OTHER; note = 2'-O-methyladenosine
  modified_base 18: mod_base = OTHER; note = 2'-O-methylinosine
  modified_base 19: mod_base = cm
  modified_base 20: mod_base = OTHER; note = 2'-O-methyladenosine
  modified_base 21: mod_base = OTHER; note = 2'-O-methyladenosine
  source 1..21: mol_type = other RNA
ggtaccgattaccacaancaa

SEQ ID NO: 1196 - RNA, 21 nt, synthetic construct
  modified_base 1: mod_base = cm
  modified_base 2: mod_base = OTHER; note = 2'-O-methyladenosine
  modified_base 3: mod_base = cm
  modified_base 4: mod_base = cm
  modified_base 5: mod_base = gm
  modified_base 6: mod_base = OTHER; note = 2'-O-methyladenosine
  modified_base 7: mod_base = um
  modified_base 8: mod_base = um
  modified_base 9: mod_base = OTHER; note = 2'-fluoroadenosine
  modified_base 10: mod_base = OTHER; note = 2'-fluorocytidine
  modified_base 11: mod_base = OTHER; note = 2'-fluorocytidine
  modified_base 12: mod_base = OTHER; note = 2'-O-methyladenosine
  modified_base 13: mod_base = cm
  modified_base 14: mod_base = OTHER; note = 2'-O-methyladenosine
  modified_base 15: mod_base = OTHER; note = 2'-O-methyladenosine
  modified_base 16: mod_base = OTHER; note = 2'-O-methylinosine
  modified_base 17: mod_base = cm
  modified_base 18: mod_base = OTHER; note = 2'-O-methyladenosine
  modified_base 19: mod_base = OTHER; note = 2'-O-methyladenosine
  modified_base 20: mod_base = cm
  modified_base 21: mod_base = OTHER; note = 2'-O-methyladenosine
  source 1..21: mol_type = other RNA
caccgattaccacaancaaca

SEQ ID NO: 1197 - RNA, 21 nt, synthetic construct
  modified_base 1: mod_base = cm
  modified_base 2: mod_base = OTHER; note = 2'-O-methyladenosine
  modified_base 3: mod_base = um
  modified_base 4: mod_base = gm
  modified_base 5: mod_base = gm
  modified_base 6: mod_base = cm
  modified_base 7: mod_base = OTHER; note = 2'-O-methyladenosine
  modified_base 8: mod_base = gm
  modified_base 9: mod_base = OTHER; note = 2'-fluoroguanosine
  modified_base 10: mod_base = OTHER; note = 2'-fluorocytidine
  modified_base 11: mod_base = OTHER; note = 2'-fluorocytidine
  modified_base 12: mod_base = OTHER; note = 2'-O-methyladenosine
  modified_base 13: mod_base = OTHER; note = 2'-O-methyladenosine
  modified_base 14: mod_base = gm
  modified_base 15: mod_base = OTHER; note = 2'-O-methyladenosine
  modified_base 16: mod_base = um
  modified_base 17: mod_base = cm
  modified_base 18: mod_base = um
  modified_base 19: mod_base = cm
  modified_base 20: mod_base = OTHER; note = 2'-O-methyladenosine
  modified_base 21: mod_base = OTHER; note = 2'-O-methyladenosine
  source 1..21: mol_type = other RNA
catggcaggccaagatctcaa

SEQ ID NO: 1198 - RNA, 21 nt, synthetic construct
  modified_base 1: mod_base = gm
  modified_base 2: mod_base = um
  modified_base 3: mod_base = gm
  modified_base 4: mod_base = OTHER; note = 2'-O-methyladenosine
  modified_base 5: mod_base = cm
  modified_base 6: mod_base = gm
  modified_base 7: mod_base = um
  modified_base 8: mod_base = um
  modified_base 9: mod_base = OTHER; note = 2'-fluoroguanosine
  modified_base 10: mod_base = OTHER; note = 2'-fluorocytidine
  modified_base 11: mod_base = OTHER; note = 2'-fluorocytidine
  modified_base 12: mod_base = cm
  modified_base 13: mod_base = um
  modified_base 14: mod_base = gm
  modified_base 15: mod_base = OTHER; note = 2'-O-methyladenosine
  modified_base 16: mod_base = um
  modified_base 17: mod_base = cm
  modified_base 18: mod_base = OTHER; note = 2'-O-methyladenosine
  modified_base 19: mod_base = OTHER; note = 2'-O-methyladenosine
  modified_base 20: mod_base = gm
  modified_base 21: mod_base = OTHER; note = 2'-O-methyladenosine
  source 1..21: mol_type = other RNA
gtgacgttgccctgatcaaga

SEQ ID NO: 1199 - RNA, 21 nt, synthetic construct
  modified_base 1: mod_base = um
  modified_base 2: mod_base = gm
  modified_base 3: mod_base = OTHER; note = 2'-O-methyladenosine
  modified_base 4: mod_base = cm
  modified_base 5: mod_base = gm
  modified_base 6: mod_base = um
  modified_base 7: mod_base = um
  modified_base 8: mod_base = gm
  modified_base 9: mod_base = OTHER; note = 2'-fluorocytidine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = gm
  modified_base 14: mod_base = OTHER; note = 2'-O-methyladenosine
  modified_base 15: mod_base = um
  modified_base 16: mod_base = cm
  modified_base 17: mod_base = OTHER; note = 2'-O-methyladenosine
  modified_base 18: mod_base = OTHER; note = 2'-O-methyladenosine
  modified_base 19: mod_base = OTHER; note = 2'-O-methylinosine
  modified_base 20: mod_base = cm
  modified_base 21: mod_base = um
  source 1..21: mol_type = other RNA
tgacgttgccctgatcaanct

SEQ ID NO: 1200 - RNA, 21 nt, synthetic construct
  modified_base 1: mod_base = um
  modified_base 2: mod_base = OTHER; note = 2'-O-methyladenosine
  modified_base 3: mod_base = cm
  modified_base 4: mod_base = gm
  modified_base 5: mod_base = um
  modified_base 6: mod_base = gm
  modified_base 7: mod_base = um
  modified_base 8: mod_base = gm
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = um
  modified_base 14: mod_base = cm
  modified_base 15: mod_base = um
  modified_base 16: mod_base = gm
  modified_base 17: mod_base = OTHER; note = 2'-O-methylinosine
  modified_base 18: mod_base = cm
  modified_base 19: mod_base = um
  modified_base 20: mod_base = um
  modified_base 21: mod_base = OTHER; note = 2'-O-methyladenosine
  source 1..21: mol_type = other RNA
tacgtgtgtccttctgnctta

SEQ ID NO: 1201 - RNA, 21 nt, synthetic construct
  modified_base 1: mod_base = um
  modified_base 2: mod_base = gm
  modified_base 3: mod_base = um
  modified_base 4: mod_base = gm
  modified_base 5: mod_base = OTHER; note = 2'-O-methyladenosine
  modified_base 6: mod_base = gm
  modified_base 7: mod_base = um
  modified_base 8: mod_base = gm
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluoroguanosine
  modified_base 12: mod_base = OTHER; note = 2'-O-methyladenosine
  modified_base 13: mod_base = gm
  modified_base 14: mod_base = OTHER; note = 2'-O-methyladenosine
  modified_base 15: mod_base = um
  modified_base 16: mod_base = cm
  modified_base 17: mod_base = um
  modified_base 18: mod_base = cm
  modified_base 19: mod_base = um
  modified_base 20: mod_base = um
  modified_base 21: mod_base = um
  source 1..21: mol_type = other RNA
tgtgagtgatgagatctcttt

SEQ ID NO: 1202 - RNA, 21 nt, synthetic construct
  modified_base 1: mod_base = um
  modified_base 2: mod_base = gm
  modified_base 3: mod_base = OTHER; note = 2'-O-methyladenosine
  modified_base 4: mod_base = gm
  modified_base 5: mod_base = um
  modified_base 6: mod_base = gm
  modified_base 7: mod_base = OTHER; note = 2'-O-methyladenosine
  modified_base 8: mod_base = um
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluoroguanosine
  modified_base 12: mod_base = OTHER; note = 2'-O-methyladenosine
  modified_base 13: mod_base = um
  modified_base 14: mod_base = cm
  modified_base 15: mod_base = um
  modified_base 16: mod_base = cm
  modified_base 17: mod_base = um
  modified_base 18: mod_base = um
  modified_base 19: mod_base = um
  modified_base 20: mod_base = cm
  modified_base 21: mod_base = OTHER; note = 2'-O-methyladenosine
  source 1..21: mol_type = other RNA
tgagtgatgagatctctttca

SEQ ID NO: 1203 - RNA, 21 nt, synthetic construct
  modified_base 1: mod_base = cm
  modified_base 2: mod_base = um
  modified_base 3: mod_base = gm
  modified_base 4: mod_base = cm
  modified_base 5: mod_base = cm
  modified_base 6: mod_base = OTHER; note = 2'-O-methyladenosine
  modified_base 7: mod_base = OTHER; note = 2'-O-methyladenosine
  modified_base 8: mod_base = gm
  modified_base 9: mod_base = OTHER; note = 2'-fluoroadenosine
  modified_base 10: mod_base = OTHER; note = 2'-fluorocytidine
  modified_base 11: mod_base = OTHER; note = 2'-fluorouridine
  modified_base 12: mod_base = cm
  modified_base 13: mod_base = cm
  modified_base 14: mod_base = um
  modified_base 15: mod_base = um
  modified_base 16: mod_base = cm
  modified_base 17: mod_base = OTHER; note = 2'-O-methyladenosine
  modified_base 18: mod_base = um
  modified_base 19: mod_base = gm
  modified_base 20: mod_base = um
  modified_base 21: mod_base = OTHER; note = 2'-O-methyladenosine
  source 1..21: mol_type = other RNA
ctgccaagactccttcatgta

SEQ ID NO: 1204 - RNA, 21 nt, synthetic construct
  modified_base 1: mod_base = cm
  modified_base 2: mod_base = cm
  modified_base 3: mod_base = OTHER; note = 2'-O-methyladenosine
  modified_base 4: mod_base = OTHER; note = 2'-O-methyladenosine
  modified_base 5: mod_base = gm
  modified_base 6: mod_base = OTHER; note = 2'-O-methyladenosine
  modified_base 7: mod_base = cm
  modified_base 8: mod_base = um
  modified_base 9: mod_base = OTHER; note = 2'-fluorocytidine
  modified_base 10: mod_base = OTHER; note = 2'-fluorocytidine
  modified_base 11: mod_base = OTHER; note = 2'-fluorouridine
  modified_base 12: mod_base = um
  modified_base 13: mod_base = cm
  modified_base 14: mod_base = OTHER; note = 2'-O-methyladenosine
  modified_base 15: mod_base = um
  modified_base 16: mod_base = gm
  modified_base 17: mod_base = um
  modified_base 18: mod_base = OTHER; note = 2'-O-methyladenosine
  modified_base 19: mod_base = cm
  modified_base 20: mod_base = OTHER; note = 2'-O-methylinosine
  modified_base 21: mod_base = OTHER; note = 2'-O-methyladenosine
  source 1..21: mol_type = other RNA
ccaagactccttcatgtacna

SEQ ID NO: 1205 - RNA, 21 nt, synthetic construct
  modified_base 1: mod_base = OTHER; note = 2'-O-methyladenosine
  modified_base 2: mod_base = gm
  modified_base 3: mod_base = OTHER; note = 2'-O-methyladenosine
  modified_base 4: mod_base = cm
  modified_base 5: mod_base = um
  modified_base 6: mod_base = cm
  modified_base 7: mod_base = cm
  modified_base 8: mod_base = um
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluoroadenosine
  modified_base 12: mod_base = um
  modified_base 13: mod_base = gm
  modified_base 14: mod_base = um
  modified_base 15: mod_base = OTHER; note = 2'-O-methyladenosine
  modified_base 16: mod_base = cm
  modified_base 17: mod_base = OTHER; note = 2'-O-methylinosine
  modified_base 18: mod_base = OTHER; note = 2'-O-methyladenosine
  modified_base 19: mod_base = cm
  modified_base 20: mod_base = OTHER; note = 2'-O-methyladenosine
  modified_base 21: mod_base = OTHER; note = 2'-O-methyladenosine
  source 1..21: mol_type = other RNA
agactccttcatgtacnacaa

SEQ ID NO: 1206 - RNA, 21 nt, synthetic construct
  modified_base 1: mod_base = gm
  modified_base 2: mod_base = OTHER; note = 2'-O-methyladenosine
  modified_base 3: mod_base = gm
  modified_base 4: mod_base = OTHER; note = 2'-O-methyladenosine
  modified_base 5: mod_base = cm
  modified_base 6: mod_base = cm
  modified_base 7: mod_base = OTHER; note = 2'-O-methyladenosine
  modified_base 8: mod_base = um
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluoroadenosine
  modified_base 12: mod_base = OTHER; note = 2'-O-methyladenosine
  modified_base 13: mod_base = gm
  modified_base 14: mod_base = gm
  modified_base 15: mod_base = OTHER; note = 2'-O-methyladenosine
  modified_base 16: mod_base = OTHER; note = 2'-O-methylinosine
  modified_base 17: mod_base = um
  modified_base 18: mod_base = cm
  modified_base 19: mod_base = gm
  modified_base 20: mod_base = OTHER; note = 2'-O-methyladenosine
  modified_base 21: mod_base = um
  source 1..21: mol_type = other RNA
gagaccatagaaggantcgat

SEQ ID NO: 1207 - RNA, 21 nt, synthetic construct
  modified_base 1: mod_base = gm
  modified_base 2: mod_base = cm
  modified_base 3: mod_base = um
  modified_base 4: mod_base = cm
  modified_base 5: mod_base = cm
  modified_base 6: mod_base = OTHER; note = 2'-O-methyladenosine
  modified_base 7: mod_base = um
  modified_base 8: mod_base = gm
  modified_base 9: mod_base = OTHER; note = 2'-fluoroadenosine
  modified_base 10: mod_base = OTHER; note = 2'-fluoroadenosine
  modified_base 11: mod_base = OTHER; note = 2'-fluorocytidine
  modified_base 12: mod_base = OTHER; note = 2'-O-methyladenosine
  modified_base 13: mod_base = um
  modified_base 14: mod_base = cm
  modified_base 15: mod_base = um
  modified_base 16: mod_base = OTHER; note = 2'-O-methyladenosine
  modified_base 17: mod_base = cm
  modified_base 18: mod_base = cm
  modified_base 19: mod_base = um
  modified_base 20: mod_base = OTHER; note = 2'-O-methylinosine
  modified_base 21: mod_base = OTHER; note = 2'-O-methyladenosine
  source 1..21: mol_type = other RNA
gctccatgaacatctacctna

SEQ ID NO: 1208 - RNA, 21 nt, synthetic construct
  modified_base 1: mod_base = gm
  modified_base 2: mod_base = OTHER; note = 2'-O-methyladenosine
  modified_base 3: mod_base = OTHER; note = 2'-O-methyladenosine
  modified_base 4: mod_base = cm
  modified_base 5: mod_base = OTHER; note = 2'-O-methyladenosine
  modified_base 6: mod_base = um
  modified_base 7: mod_base = cm
  modified_base 8: mod_base = um
  modified_base 9: mod_base = OTHER; note = 2'-fluoroadenosine
  modified_base 10: mod_base = OTHER; note = 2'-fluorocytidine
  modified_base 11: mod_base = OTHER; note = 2'-fluorocytidine
  modified_base 12: mod_base = um
  modified_base 13: mod_base = gm
  modified_base 14: mod_base = gm
  modified_base 15: mod_base = um
  modified_base 16: mod_base = OTHER; note = 2'-O-methylinosine
  modified_base 17: mod_base = cm
  modified_base 18: mod_base = um
  modified_base 19: mod_base = OTHER; note = 2'-O-methyladenosine
  modified_base 20: mod_base = gm
  modified_base 21: mod_base = OTHER; note = 2'-O-methyladenosine
  source 1..21: mol_type = other RNA
gaacatctacctggtnctaga

SEQ ID NO: 1209 - RNA, 21 nt, synthetic construct
  modified_base 1: mod_base = gm
  modified_base 2: mod_base = um
  modified_base 3: mod_base = gm
  modified_base 4: mod_base = gm
  modified_base 5: mod_base = OTHER; note = 2'-O-methyladenosine
  modified_base 6: mod_base = um
  modified_base 7: mod_base = cm
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluoroadenosine
  modified_base 11: mod_base = OTHER; note = 2'-fluorocytidine
  modified_base 12: mod_base = OTHER; note = 2'-O-methyladenosine
  modified_base 13: mod_base = gm
  modified_base 14: mod_base = cm
  modified_base 15: mod_base = OTHER; note = 2'-O-methyladenosine
  modified_base 16: mod_base = um
  modified_base 17: mod_base = um
  modified_base 18: mod_base = gm
  modified_base 19: mod_base = OTHER; note = 2'-O-methylinosine
  modified_base 20: mod_base = gm
  modified_base 21: mod_base = OTHER; note = 2'-O-methyladenosine
  source 1..21: mol_type = other RNA
gtggatcagacagcattgnga

SEQ ID NO: 1210 - RNA, 21 nt, synthetic construct
  modified_base 1: mod_base = gm
  modified_base 2: mod_base = OTHER; note = 2'-O-methyladenosine
  modified_base 3: mod_base = gm
  modified_base 4: mod_base = cm
  modified_base 5: mod_base = cm
  modified_base 6: mod_base = OTHER; note = 2'-O-methyladenosine
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluoroadenosine
  modified_base 11: mod_base = OTHER; note = 2'-fluoroguanosine
  modified_base 12: mod_base = um
  modified_base 13: mod_base = gm
  modified_base 14: mod_base = um
  modified_base 15: mod_base = cm
  modified_base 16: mod_base = um
  modified_base 17: mod_base = OTHER; note = 2'-O-methyladenosine
  modified_base 18: mod_base = OTHER; note = 2'-O-methylinosine
  modified_base 19: mod_base = um
  modified_base 20: mod_base = cm
  modified_base 21: mod_base = OTHER; note = 2'-O-methyladenosine
  source 1..21: mol_type = other RNA
gagccaaaaagtgtctantca

SEQ ID NO: 1211 - RNA, 21 nt, synthetic construct
  modified_base 1: mod_base = gm
  modified_base 2: mod_base = OTHER; note = 2'-O-methyladenosine
  modified_base 3: mod_base = gm
  modified_base 4: mod_base = OTHER; note = 2'-O-methyladenosine
  modified_base 5: mod_base = OTHER; note = 2'-O-methyladenosine
  modified_base 6: mod_base = gm
  modified_base 7: mod_base = gm
  modified_base 8: mod_base = um
  modified_base 9: mod_base = OTHER; note = 2'-fluoroguanosine
  modified_base 10: mod_base = OTHER; note = 2'-fluoroguanosine
  modified_base 11: mod_base = OTHER; note = 2'-fluorocytidine
  modified_base 12: mod_base = OTHER; note = 2'-O-methyladenosine
  modified_base 13: mod_base = OTHER; note = 2'-O-methyladenosine
  modified_base 14: mod_base = gm
  modified_base 15: mod_base = um
  modified_base 16: mod_base = um
  modified_base 17: mod_base = OTHER; note = 2'-O-methyladenosine
  modified_base 18: mod_base = um
  modified_base 19: mod_base = gm
  modified_base 20: mod_base = gm
  modified_base 21: mod_base = um
  source 1..21: mol_type = other RNA
gagaaggtggcaagttatggt

SEQ ID NO: 1212 - RNA, 21 nt, synthetic construct
  modified_base 1: mod_base = gm
  modified_base 2: mod_base = OTHER; note = 2'-O-methyladenosine
  modified_base 3: mod_base = gm
  modified_base 4: mod_base = um
  modified_base 5: mod_base = um
  modified_base 6: mod_base = OTHER; note = 2'-O-methyladenosine
  modified_base 7: mod_base = um
  modified_base 8: mod_base = gm
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluoroguanosine
  modified_base 12: mod_base = um
  modified_base 13: mod_base = gm
  modified_base 14: mod_base = OTHER; note = 2'-O-methyladenosine
  modified_base 15: mod_base = OTHER; note = 2'-O-methyladenosine
  modified_base 16: mod_base = OTHER; note = 2'-O-methylinosine
  modified_base 17: mod_base = cm
  modified_base 18: mod_base = cm
  modified_base 19: mod_base = OTHER; note = 2'-O-methyladenosine
  modified_base 20: mod_base = OTHER; note = 2'-O-methyladenosine
  modified_base 21: mod_base = OTHER; note = 2'-O-methyladenosine
  source 1..21: mol_type = other RNA
gagttatggtgtgaanccaaa

SEQ ID NO: 1213 - RNA, 21 nt, synthetic construct
  modified_base 1: mod_base = OTHER; note = 2'-O-methyladenosine
  modified_base 2: mod_base = gm
  modified_base 3: mod_base = gm
  modified_base 4: mod_base = cm
  modified_base 5: mod_base = OTHER; note = 2'-O-methyladenosine
  modified_base 6: mod_base = gm
  modified_base 7: mod_base = um
  modified_base 8: mod_base = gm
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluorocytidine
  modified_base 12: mod_base = OTHER; note = 2'-O-methyladenosine
  modified_base 13: mod_base = gm
  modified_base 14: mod_base = cm
  modified_base 15: mod_base = OTHER; note = 2'-O-methyladenosine
  modified_base 16: mod_base = um
  modified_base 17: mod_base = gm
  modified_base 18: mod_base = OTHER; note = 2'-O-methyladenosine
  modified_base 19: mod_base = um
  modified_base 20: mod_base = gm
  modified_base 21: mod_base = OTHER; note = 2'-O-methyladenosine
  source 1..21: mol_type = other RNA
aggcagtgtacagcatgatga

SEQ ID NO: 1214 - RNA, 21 nt, synthetic construct
  modified_base 1: mod_base = gm
  modified_base 2: mod_base = gm
  modified_base 3: mod_base = OTHER; note = 2'-O-methyladenosine
  modified_base 4: mod_base = cm
  modified_base 5: mod_base = cm
  modified_base 6: mod_base = cm
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorouridine
  modified_base 11: mod_base = OTHER; note = 2'-fluoroadenosine
  modified_base 12: mod_base = cm
  modified_base 13: mod_base = um
  modified_base 14: mod_base = gm
  modified_base 15: mod_base = um
  modified_base 16: mod_base = cm
  modified_base 17: mod_base = OTHER; note = 2'-O-methyladenosine
  modified_base 18: mod_base = um
  modified_base 19: mod_base = um
  modified_base 20: mod_base = gm
  modified_base 21: mod_base = OTHER; note = 2'-O-methyladenosine
  source 1..21: mol_type = other RNA
ggacccaattactgtcattga

SEQ ID NO: 1215 - RNA, 21 nt, synthetic construct
  modified_base 1: mod_base = gm
  modified_base 2: mod_base = OTHER; note = 2'-O-methyladenosine
  modified_base 3: mod_base = cm
  modified_base 4: mod_base = cm
  modified_base 5: mod_base = cm
  modified_base 6: mod_base = OTHER; note = 2'-O-methyladenosine
  modified_base 7: mod_base = OTHER; note = 2'-O-methyladenosine
  modified_base 8: mod_base = um
  modified_base 9: mod_base = OTHER; note = 2'-fluorouridine
  modified_base 10: mod_base = OTHER; note = 2'-fluoroadenosine
  modified_base 11: mod_base = OTHER; note = 2'-fluorocytidine
  modified_base 12: mod_base = um
  modified_base 13: mod_base = gm
  modified_base 14: mod_base = um
  modified_base 15: mod_base = cm
  modified_base 16: mod_base = OTHER; note = 2'-O-methyladenosine
  modified_base 17: mod_base = um
  modified_base 18: mod_base = um
  modified_base 19: mod_base = gm
  modified_base 20: mod_base = OTHER; note = 2'-O-methyladenosine
  modified_base 21: mod_base = um
  source 1..21: mol_type = other RNA
gacccaattactgtcattgat

SEQ ID NO: 1216 - RNA, 21 nt, synthetic construct
  modified_base 1: mod_base = cm
  modified_base 2: mod_base = OTHER; note = 2'-O-methyladenosine
  modified_base 3: mod_base = cm
  modified_base 4: mod_base = um
  modified_base 5: mod_base = gm
  modified_base 6: mod_base = um
  modified_base 7: mod_base = cm
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorouridine
  modified_base 11: mod_base = OTHER; note = 2'-fluoroguanosine
  modified_base 12: mod_base = OTHER; note = 2'-O-methyladenosine
  modified_base 13: mod_base = um
  modified_base 14: mod_base = gm
  modified_base 15: mod_base = OTHER; note = 2'-O-methyladenosine
  modified_base 16: mod_base = OTHER; note = 2'-O-methylinosine
  modified_base 17: mod_base = OTHER; note = 2'-O-methyladenosine
  modified_base 18: mod_base = um
  modified_base 19: mod_base = cm
  modified_base 20: mod_base = cm
  modified_base 21: mod_base = OTHER; note = 2'-O-methyladenosine
  source 1..21: mol_type = other RNA
cactgtcattgatganatcca

SEQ ID NO: 1217 - RNA, 21 nt, synthetic construct
  modified_base 1: mod_base = gm
  modified_base 2: mod_base = gm
  modified_base 3: mod_base = OTHER; note = 2'-O-methyladenosine
  modified_base 4: mod_base = gm
  modified_base 5: mod_base = gm
  modified_base 6: mod_base = OTHER; note = 2'-O-methyladenosine
  modified_base 7: mod_base = um
  modified_base 8: mod_base = um
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = gm
  modified_base 15: mod_base = OTHER; note = 2'-O-methyladenosine
  modified_base 16: mod_base = um
  modified_base 17: mod_base = gm
  modified_base 18: mod_base = um
  modified_base 19: mod_base = cm
  modified_base 20: mod_base = um
  modified_base 21: mod_base = OTHER; note = 2'-O-methyladenosine
  source 1..21: mol_type = other RNA
ggaggattatctggatgtcta

SEQ ID NO: 1218 - RNA, 21 nt, synthetic construct
  modified_base 1: mod_base = cm
  modified_base 2: mod_base = OTHER; note = 2'-O-methyladenosine
  modified_base 3: mod_base = um
  modified_base 4: mod_base = cm
  modified_base 5: mod_base = um
  modified_base 6: mod_base = gm
  modified_base 7: mod_base = gm
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluoroguanosine
  modified_base 11: mod_base = OTHER; note = 2'-fluorouridine
  modified_base 12: mod_base = cm
  modified_base 13: mod_base = um
  modified_base 14: mod_base = OTHER; note = 2'-O-methyladenosine
  modified_base 15: mod_base = um
  modified_base 16: mod_base = gm
  modified_base 17: mod_base = um
  modified_base 18: mod_base = gm
  modified_base 19: mod_base = um
  modified_base 20: mod_base = um
  modified_base 21: mod_base = um
  source 1..21: mol_type = other RNA
catctggatgtctatgtgttt

SEQ ID NO: 1219 - RNA, 21 nt, synthetic construct
  modified_base 1: mod_base = um
  modified_base 2: mod_base = cm
  modified_base 3: mod_base = um
  modified_base 4: mod_base = gm
  modified_base 5: mod_base = gm
  modified_base 6: mod_base = OTHER; note = 2'-O-methyladenosine
  modified_base 7: mod_base = um
  modified_base 8: mod_base = gm
  modified_base 9: mod_base = OTHER; note = 2'-fluorouridine
  modified_base 10: mod_base = OTHER; note = 2'-fluorocytidine
  modified_base 11: mod_base = OTHER; note = 2'-fluorouridine
  modified_base 12: mod_base = OTHER; note = 2'-O-methyladenosine
  modified_base 13: mod_base = um
  modified_base 14: mod_base = gm
  modified_base 15: mod_base = um
  modified_base 16: mod_base = gm
  modified_base 17: mod_base = um
  modified_base 18: mod_base = um
  modified_base 19: mod_base = um
  modified_base 20: mod_base = gm
  modified_base 21: mod_base = OTHER; note = 2'-O-methyladenosine
  source 1..21: mol_type = other RNA
tctggatgtctatgtgtttga

SEQ ID NO: 1220 - RNA, 21 nt, synthetic construct
  modified_base 1: mod_base = cm
  modified_base 2: mod_base = cm
  modified_base 3: mod_base = OTHER; note = 2'-O-methyladenosine
  modified_base 4: mod_base = OTHER; note = 2'-O-methyladenosine
  modified_base 5: mod_base = gm
  modified_base 6: mod_base = um
  modified_base 7: mod_base = gm
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluorocytidine
  modified_base 11: mod_base = OTHER; note = 2'-fluoroadenosine
  modified_base 12: mod_base = um
  modified_base 13: mod_base = cm
  modified_base 14: mod_base = OTHER; note = 2'-O-methyladenosine
  modified_base 15: mod_base = OTHER; note = 2'-O-methyladenosine
  modified_base 16: mod_base = um
  modified_base 17: mod_base = gm
  modified_base 18: mod_base = cm
  modified_base 19: mod_base = um
  modified_base 20: mod_base = um
  modified_base 21: mod_base = um
  source 1..21: mol_type = other RNA
ccaagtgaacatcaatgcttt

SEQ ID NO: 1221 - RNA, 21 nt, synthetic construct
  modified_base 1: mod_base = gm
  modified_base 2: mod_base = um
  modified_base 3: mod_base = gm
  modified_base 4: mod_base = OTHER; note = 2'-O-methyladenosine
  modified_base 5: mod_base = OTHER; note = 2'-O-methyladenosine
  modified_base 6: mod_base = cm
  modified_base 7: mod_base = OTHER; note = 2'-O-methyladenosine
  modified_base 8: mod_base = um
  modified_base 9: mod_base = OTHER; note = 2'-fluorocytidine
  modified_base 10: mod_base = OTHER; note = 2'-fluoroadenosine
  modified_base 11: mod_base = OTHER; note = 2'-fluoroadenosine
  modified_base 12: mod_base = um
  modified_base 13: mod_base = gm
  modified_base 14: mod_base = cm
  modified_base 15: mod_base = um
  modified_base 16: mod_base = um
  modified_base 17: mod_base = um
  modified_base 18: mod_base = gm
  modified_base 19: mod_base = OTHER; note = 2'-O-methylinosine
  modified_base 20: mod_base = cm
  modified_base 21: mod_base = um
  source 1..21: mol_type = other RNA
gtgaacatcaatgctttgnct

SEQ ID NO: 1222 - RNA, 21 nt, synthetic construct
  modified_base 1: mod_base = gm
  modified_base 2: mod_base = OTHER; note = 2'-O-methyladenosine
  modified_base 3: mod_base = OTHER; note = 2'-O-methyladenosine
  modified_base 4: mod_base = cm
  modified_base 5: mod_base = OTHER; note = 2'-O-methyladenosine
  modified_base 6: mod_base = um
  modified_base 7: mod_base = cm
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluoroguanosine
  modified_base 12: mod_base = cm
  modified_base 13: mod_base = um
  modified_base 14: mod_base = um
  modified_base 15: mod_base = um
  modified_base 16: mod_base = gm
  modified_base 17: mod_base = OTHER; note = 2'-O-methylinosine
  modified_base 18: mod_base = cm
  modified_base 19: mod_base = um
  modified_base 20: mod_base = um
  modified_base 21: mod_base = OTHER; note = 2'-O-methyladenosine
  source 1..21: mol_type = other RNA
gaacatcaatgctttgnctta

SEQ ID NO: 1223 - RNA, 21 nt, synthetic construct
  modified_base 1: mod_base = cm
  modified_base 2: mod_base = OTHER; note = 2'-O-methyladenosine
  modified_base 3: mod_base = OTHER; note = 2'-O-methyladenosine
  modified_base 4: mod_base = gm
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = gm
  modified_base 9: mod_base = OTHER; note = 2'-fluoroadenosine
  modified_base 10: mod_base = OTHER; note = 2'-fluorocytidine
  modified_base 11: mod_base = OTHER; note = 2'-fluoroadenosine
  modified_base 12: mod_base = OTHER; note = 2'-O-methyladenosine
  modified_base 13: mod_base = um
  modified_base 14: mod_base = gm
  modified_base 15: mod_base = OTHER; note = 2'-O-methyladenosine
  modified_base 16: mod_base = OTHER; note = 2'-O-methylinosine
  modified_base 17: mod_base = cm
  modified_base 18: mod_base = OTHER; note = 2'-O-methyladenosine
  modified_base 19: mod_base = OTHER; note = 2'-O-methyladenosine
  modified_base 20: mod_base = cm
  modified_base 21: mod_base = OTHER; note = 2'-O-methyladenosine
  source 1..21: mol_type = other RNA
caagaaagacaatgancaaca

SEQ ID NO: 1224 - RNA, 21 nt, synthetic construct
  modified_base 1: mod_base = gm
  modified_base 2: mod_base = OTHER; note = 2'-O-methyl-2-aminoadenosine
  modified_base 3: mod_base = OTHER; note = 2'-O-methyladenosine
  modified_base 4: mod_base = OTHER; note = 2'-O-methyladenosine
  modified_base 5: mod_base = gm
  modified_base 6: mod_base = OTHER; note = 2'-O-methyladenosine
  modified_base 7: mod_base = cm
  modified_base 8: mod_base = OTHER; note = 2'-O-methyladenosine
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluoroguanosine
  modified_base 12: mod_base = OTHER; note = 2'-O-methyladenosine
  modified_base 13: mod_base = gm
  modified_base 14: mod_base = cm
  modified_base 15: mod_base = OTHER; note = 2'-O-methyladenosine
  modified_base 16: mod_base = OTHER; note = 2'-O-methyladenosine
  modified_base 17: mod_base = cm
  modified_base 18: mod_base = OTHER; note = 2'-O-methyladenosine
  modified_base 19: mod_base = um
  modified_base 20: mod_base = gm
  modified_base 21: mod_base = um
  source 1..21: mol_type = other RNA
gnaagacaatgagcaacatgt

SEQ ID NO: 1225 - RNA, 21 nt, synthetic construct
  modified_base 1: mod_base = gm
  modified_base 2: mod_base = gm
  modified_base 3: mod_base = um
  modified_base 4: mod_base = gm
  modified_base 5: mod_base = um
  modified_base 6: mod_base = cm
  modified_base 7: mod_base = um
  modified_base 8: mod_base = gm
  modified_base 9: mod_base = OTHER; note = 2'-fluoroadenosine
  modified_base 10: mod_base = OTHER; note = 2'-fluoroguanosine
  modified_base 11: mod_base = OTHER; note = 2'-fluorouridine
  modified_base 12: mod_base = OTHER; note = 2'-O-methyladenosine
  modified_base 13: mod_base = cm
  modified_base 14: mod_base = um
  modified_base 15: mod_base = um
  modified_base 16: mod_base = um
  modified_base 17: mod_base = gm
  modified_base 18: mod_base = um
  modified_base 19: mod_base = OTHER; note = 2'-O-methylinosine
  modified_base 20: mod_base = cm
  modified_base 21: mod_base = um
  source 1..21: mol_type = other RNA
ggtgtctgagtactttgtnct

SEQ ID NO: 1226 - RNA, 21 nt, synthetic construct
  modified_base 1: mod_base = gm
  modified_base 2: mod_base = um
  modified_base 3: mod_base = gm
  modified_base 4: mod_base = um
  modified_base 5: mod_base = cm
  modified_base 6: mod_base = um
  modified_base 7: mod_base = gm
  modified_base 8: mod_base = OTHER; note = 2'-O-methyladenosine
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluoroadenosine
  modified_base 12: mod_base = cm
  modified_base 13: mod_base = um
  modified_base 14: mod_base = um
  modified_base 15: mod_base = um
  modified_base 16: mod_base = gm
  modified_base 17: mod_base = um
  modified_base 18: mod_base = OTHER; note = 2'-O-methylinosine
  modified_base 19: mod_base = cm
  modified_base 20: mod_base = um
  modified_base 21: mod_base = OTHER; note = 2'-O-methyladenosine
  source 1..21: mol_type = other RNA
gtgtctgagtactttgtncta

SEQ ID NO: 1227 - RNA, 21 nt, synthetic construct
  modified_base 1: mod_base = gm
  modified_base 2: mod_base = cm
  modified_base 3: mod_base = um
  modified_base 4: mod_base = gm
  modified_base 5: mod_base = OTHER; note = 2'-O-methyladenosine
  modified_base 6: mod_base = cm
  modified_base 7: mod_base = OTHER; note = 2'-O-methyladenosine
  modified_base 8: mod_base = gm
  modified_base 9: mod_base = OTHER; note = 2'-fluorocytidine
  modified_base 10: mod_base = OTHER; note = 2'-fluoroadenosine
  modified_base 11: mod_base = OTHER; note = 2'-fluoroguanosine
  modified_base 12: mod_base = cm
  modified_base 13: mod_base = OTHER; note = 2'-O-methyladenosine
  modified_base 14: mod_base = cm
  modified_base 15: mod_base = OTHER; note = 2'-O-methyladenosine
  modified_base 16: mod_base = um
  modified_base 17: mod_base = um
  modified_base 18: mod_base = gm
  modified_base 19: mod_base = um
  modified_base 20: mod_base = um
  modified_base 21: mod_base = um
  source 1..21: mol_type = other RNA
gctgacagcagcacattgttt

SEQ ID NO: 1228 - RNA, 21 nt, synthetic construct
  modified_base 1: mod_base = gm
  modified_base 2: mod_base = cm
  modified_base 3: mod_base = um
  modified_base 4: mod_base = gm
  modified_base 5: mod_base = um
  modified_base 6: mod_base = gm
  modified_base 7: mod_base = gm
  modified_base 8: mod_base = um
  modified_base 9: mod_base = OTHER; note = 2'-fluoroguanosine
  modified_base 10: mod_base = um
  modified_base 11: mod_base = OTHER; note = 2'-fluorocytidine
  modified_base 12: mod_base = OTHER; note = 2'-fluorouridine
  modified_base 13: mod_base = gm
  modified_base 14: mod_base = OTHER; note = 2'-O-methyladenosine
  modified_base 15: mod_base = gm
  modified_base 16: mod_base = um
  modified_base 17: mod_base = OTHER; note = 2'-O-methyladenosine
  modified_base 18: mod_base = cm
  modified_base 19: mod_base = um
  modified_base 20: mod_base = um
  modified_base 21: mod_base = um
  source 1..21: mol_type = other RNA
gctgtggtgtctgagtacttt

SEQ ID NO: 1229 - RNA, 21 nt, synthetic construct
  modified_base 1: mod_base = gm
  modified_base 2: mod_base = cm
  modified_base 3: mod_base = um
  modified_base 4: mod_base = gm
  modified_base 5: mod_base = um
  modified_base 6: mod_base = gm
  modified_base 7: mod_base = gm
  modified_base 8: mod_base = um
  modified_base 9: mod_base = OTHER; note = 2'-fluoroguanosine
  modified_base 10: mod_base = um
  modified_base 11: mod_base = OTHER; note = 2'-fluorocytidine
  modified_base 12: mod_base = um
  modified_base 13: mod_base = OTHER; note = 2'-fluoroguanosine
  modified_base 14: mod_base = OTHER; note = 2'-O-methyladenosine
  modified_base 15: mod_base = gm
  modified_base 16: mod_base = um
  modified_base 17: mod_base = OTHER; note = 2'-O-methyladenosine
  modified_base 18: mod_base = cm
  modified_base 19: mod_base = um
  modified_base 20: mod_base = um
  modified_base 21: mod_base = um
  source 1..21: mol_type = other RNA
gctgtggtgtctgagtacttt

SEQ ID NO: 1230 - RNA, 21 nt, synthetic construct
  modified_base 1: mod_base = gm
  modified_base 2: mod_base = cm
  modified_base 3: mod_base = um
  modified_base 4: mod_base = gm
  modified_base 5: mod_base = um
  modified_base 6: mod_base = gm
  modified_base 7: mod_base = OTHER; note = 2'-fluoroguanosine
  modified_base 8: mod_base = um
  modified_base 9: mod_base = OTHER; note = 2'-fluoroguanosine
  modified_base 10: mod_base = um
  modified_base 11: mod_base = OTHER; note = 2'-fluorocytidine
  modified_base 12: mod_base = um
  modified_base 13: mod_base = gm
  modified_base 14: mod_base = OTHER; note = 2'-O-methyladenosine
  modified_base 15: mod_base = gm
  modified_base 16: mod_base = um
  modified_base 17: mod_base = OTHER; note = 2'-O-methyladenosine
  modified_base 18: mod_base = cm
  modified_base 19: mod_base = um
  modified_base 20: mod_base = um
  modified_base 21: mod_base = um
  source 1..21: mol_type = other RNA
gctgtggtgtctgagtacttt

SEQ ID NO: 1231 - RNA, 21 nt, synthetic construct
  modified_base 1: mod_base = gm
  modified_base 2: mod_base = OTHER; note = 2'-O-methyladenosine
  modified_base 3: mod_base = um
  modified_base 4: mod_base = gm
  modified_base 5: mod_base = OTHER; note = 2'-O-methyladenosine
  modified_base 6: mod_base = gm
  modified_base 7: mod_base = gm
  modified_base 8: mod_base = OTHER; note = 2'-O-methyladenosine
  modified_base 9: mod_base = OTHER; note = 2'-fluorouridine
  modified_base 10: mod_base = um
  modified_base 11: mod_base = um
  modified_base 12: mod_base = OTHER; note = 2'-fluoroguanosine
  modified_base 13: mod_base = gm
  modified_base 14: mod_base = gm
  modified_base 15: mod_base = um
  modified_base 16: mod_base = um
  modified_base 17: mod_base = um
  modified_base 18: mod_base = um
  modified_base 19: mod_base = cm
  modified_base 20: mod_base = um
  modified_base 21: mod_base = OTHER; note = 2'-O-methyladenosine
  source 1..21: mol_type = other RNA
gatgaggatttgggttttcta

SEQ ID NO: 1232 - RNA, 21 nt, synthetic construct
  modified_base 1: mod_base = gm
  modified_base 2: mod_base = OTHER; note = 2'-O-methyladenosine
  modified_base 3: mod_base = um
  modified_base 4: mod_base = gm
  modified_base 5: mod_base = OTHER; note = 2'-O-methyladenosine
  modified_base 6: mod_base = gm
  modified_base 7: mod_base = gm
  modified_base 8: mod_base = OTHER; note = 2'-O-methyladenosine
  modified_base 9: mod_base = OTHER; note = 2'-deoxy-5-methyluridine
  modified_base 10: mod_base = um
  modified_base 11: mod_base = um
  modified_base 12: mod_base = OTHER; note = 2'-deoxyguanosine
  modified_base 13: mod_base = gm
  modified_base 14: mod_base = gm
  modified_base 15: mod_base = um
  modified_base 16: mod_base = um
  modified_base 17: mod_base = um
  modified_base 18: mod_base = um
  modified_base 19: mod_base = cm
  modified_base 20: mod_base = um
  modified_base 21: mod_base = OTHER; note = 2'-O-methyladenosine
  source 1..21: mol_type = other RNA
gatgaggatttgggttttcta

SEQ ID NO: 1233 - RNA, 21 nt, synthetic construct
  modified_base 1: mod_base = gm
  modified_base 2: mod_base = gm
  modified_base 3: mod_base = um
  modified_base 4: mod_base = gm
  modified_base 5: mod_base = OTHER; note = 2'-O-methyladenosine
  modified_base 6: mod_base = gm
  modified_base 7: mod_base = gm
  modified_base 8: mod_base = OTHER; note = 2'-O-methyladenosine
  modified_base 9: mod_base = OTHER; note = 2'-fluorouridine
  modified_base 10: mod_base = um
  modified_base 11: mod_base = OTHER; note = 2'-fluorouridine
  modified_base 12: mod_base = OTHER; note = 2'-fluoroguanosine
  modified_base 13: mod_base = gm
  modified_base 14: mod_base = gm
  modified_base 15: mod_base = um
  modified_base 16: mod_base = um
  modified_base 17: mod_base = um
  modified_base 18: mod_base = um
  modified_base 19: mod_base = cm
  modified_base 20: mod_base = um
  modified_base 21: mod_base = OTHER; note = 2'-O-methyladenosine
  source 1..21: mol_type = other RNA
ggtgaggatttgggttttcta

SEQ ID NO: 1234 - RNA, 21 nt, synthetic construct
  modified_base 1: mod_base = gm
  modified_base 2: mod_base = cm
  modified_base 3: mod_base = um
  modified_base 4: mod_base = gm
  modified_base 5: mod_base = OTHER; note = 2'-O-methyladenosine
  modified_base 6: mod_base = gm
  modified_base 7: mod_base = gm
  modified_base 8: mod_base = OTHER; note = 2'-O-methyladenosine
  modified_base 9: mod_base = OTHER; note = 2'-fluorouridine
  modified_base 10: mod_base = um
  modified_base 11: mod_base = OTHER; note = 2'-fluorouridine
  modified_base 12: mod_base = OTHER; note = 2'-fluoroguanosine
  modified_base 13: mod_base = gm
  modified_base 14: mod_base = gm
  modified_base 15: mod_base = um
  modified_base 16: mod_base = um
  modified_base 17: mod_base = um
  modified_base 18: mod_base = um
  modified_base 19: mod_base = cm
  modified_base 20: mod_base = um
  modified_base 21: mod_base = OTHER; note = 2'-O-methyladenosine
  source 1..21: mol_type = other RNA
gctgaggatttgggttttcta

SEQ ID NO: 1235 - RNA, 21 nt, synthetic construct
  modified_base 1: mod_base = gm
  modified_base 2: mod_base = cm
  modified_base 3: mod_base = um
  modified_base 4: mod_base = gm
  modified_base 5: mod_base = um
  modified_base 6: mod_base = gm
  modified_base 7: mod_base = gm
  modified_base 8: mod_base = um
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = OTHER; note = 2'-O-methyladenosine
  modified_base 15: mod_base = gm
  modified_base 16: mod_base = um
  modified_base 17: mod_base = OTHER; note = 2'-O-methyladenosine
  modified_base 18: mod_base = cm
  modified_base 19: mod_base = um
  modified_base 20: mod_base = um
  modified_base 21: mod_base = OTHER; note = 2'-O-methyladenosine
  source 1..21: mol_type = other RNA
gctgtggtgtctgagtactta

SEQ ID NO: 1236 - RNA, 21 nt, synthetic construct
  modified_base 1: mod_base = gm
  modified_base 2: mod_base = cm
  modified_base 3: mod_base = um
  modified_base 4: mod_base = gm
  modified_base 5: mod_base = um
  modified_base 6: mod_base = gm
  modified_base 7: mod_base = gm
  modified_base 8: mod_base = um
  modified_base 9: mod_base = OTHER; note = 2'-deoxyguanosine
  modified_base 10: mod_base = um
  modified_base 11: mod_base = OTHER; note = 2'-deoxyguanosine
  modified_base 12: mod_base = um
  modified_base 13: mod_base = gm
  modified_base 14: mod_base = OTHER; note = 2'-O-methyladenosine
  modified_base 15: mod_base = gm
  modified_base 16: mod_base = um
  modified_base 17: mod_base = OTHER; note = 2'-O-methyladenosine
  modified_base 18: mod_base = cm
  modified_base 19: mod_base = um
  modified_base 20: mod_base = um
  modified_base 21: mod_base = um
  source 1..21: mol_type = other RNA
gctgtggtgtctgagtacttt

SEQ ID NO: 1237 - RNA, 21 nt, synthetic construct
  modified_base 1: mod_base = OTHER; note = 2'-O-methyladenosine
  modified_base 2: mod_base = gm
  modified_base 3: mod_base = OTHER; note = 2'-O-methyladenosine
  modified_base 4: mod_base = um
  modified_base 5: mod_base = gm
  modified_base 6: mod_base = OTHER; note = 2'-O-methyladenosine
  modified_base 7: mod_base = gm
  modified_base 8: mod_base = gm
  modified_base 9: mod_base = OTHER; note = 2'-fluoroadenosine
  modified_base 10: mod_base = OTHER; note = 2'-fluorouridine
  modified_base 11: mod_base = OTHER; note = 2'-fluorouridine
  modified_base 12: mod_base = um
  modified_base 13: mod_base = gm
  modified_base 14: mod_base = gm
  modified_base 15: mod_base = gm
  modified_base 16: mod_base = um
  modified_base 17: mod_base = um
  modified_base 18: mod_base = um
  modified_base 19: mod_base = um
  modified_base 20: mod_base = cm
  modified_base 21: mod_base = um
  source 1..21: mol_type = other RNA
agatgaggatttgggttttct

SEQ ID NO: 1238 - RNA, 21 nt, synthetic construct
  modified_base 1: mod_base = gm
  modified_base 2: mod_base = OTHER; note = 2'-O-methyladenosine
  modified_base 3: mod_base = um
  modified_base 4: mod_base = gm
  modified_base 5: mod_base = OTHER; note = 2'-O-methyladenosine
  modified_base 6: mod_base = gm
  modified_base 7: mod_base = gm
  modified_base 8: mod_base = OTHER; note = 2'-O-methyladenosine
  modified_base 9: mod_base = OTHER; note = 2'-fluorouridine
  modified_base 10: mod_base = um
  modified_base 11: mod_base = OTHER; note = 2'-fluorouridine
  modified_base 12: mod_base = gm
  modified_base 13: mod_base = gm
  modified_base 14: mod_base = gm
  modified_base 15: mod_base = um
  modified_base 16: mod_base = um
  modified_base 17: mod_base = um
  modified_base 18: mod_base = um
  modified_base 19: mod_base = cm
  modified_base 20: mod_base = um
  modified_base 21: mod_base = OTHER; note = 2'-O-methyladenosine
  source 1..21: mol_type = other RNA
gatgaggatttgggttttcta

SEQ ID NO: 1239 - RNA, 21 nt, synthetic construct
  modified_base 1: mod_base = gm
  modified_base 2: mod_base = OTHER; note = 2'-O-methyladenosine
  modified_base 3: mod_base = um
  modified_base 4: mod_base = gm
  modified_base 5: mod_base = OTHER; note = 2'-O-methyladenosine
  modified_base 6: mod_base = gm
  modified_base 7: mod_base = gm
  modified_base 8: mod_base = OTHER; note = 2'-O-methyladenosine
  modified_base 9: mod_base = OTHER; note = uridine
  modified_base 10: mod_base = um
  modified_base 11: mod_base = OTHER; note = 2'-fluorouridine
  modified_base 12: mod_base = gm
  modified_base 13: mod_base = gm
  modified_base 14: mod_base = gm
  modified_base 15: mod_base = um
  modified_base 16: mod_base = um
  modified_base 17: mod_base = um
  modified_base 18: mod_base = um
  modified_base 19: mod_base = cm
  modified_base 20: mod_base = um
  modified_base 21: mod_base = OTHER; note = 2'-O-methyladenosine
  source 1..21: mol_type = other RNA
gatgaggatttgggttttcta

SEQ ID NO: 1240 - RNA, 21 nt, synthetic construct
  modified_base 1: mod_base = gm
  modified_base 2: mod_base = OTHER; note = 2'-O-methyladenosine
  modified_base 3: mod_base = um
  modified_base 4: mod_base = gm
  modified_base 5: mod_base = OTHER; note = 2'-O-methyladenosine
  modified_base 6: mod_base = gm
  modified_base 7: mod_base = gm
  modified_base 8: mod_base = OTHER; note = 2'-O-methyladenosine
  modified_base 9: mod_base = OTHER; note = 2'-fluorouridine
  modified_base 10: mod_base = um
  modified_base 11: mod_base = OTHER; note = uridine
  modified_base 12: mod_base = gm
  modified_base 13: mod_base = gm
  modified_base 14: mod_base = gm
  modified_base 15: mod_base = um
  modified_base 16: mod_base = um
  modified_base 17: mod_base = um
  modified_base 18: mod_base = um
  modified_base 19: mod_base = cm
  modified_base 20: mod_base = um
  modified_base 21: mod_base = OTHER; note = 2'-O-methyladenosine
  source 1..21: mol_type = other RNA
gatgaggatttgggttttcta

SEQ ID NO: 1241 - RNA, 21 nt, synthetic construct
  modified_base 1: mod_base = gm
  modified_base 2: mod_base = OTHER; note = 2'-O-methyladenosine
  modified_base 3: mod_base = um
  modified_base 4: mod_base = gm
  modified_base 5: mod_base = OTHER; note = 2'-O-methyladenosine
  modified_base 6: mod_base = gm
  modified_base 7: mod_base = gm
  modified_base 8: mod_base = OTHER; note = 2'-O-methyladenosine
  modified_base 9: mod_base = OTHER; note = 2'-deoxy-5-methyluridine
  modified_base 10: mod_base = um
  modified_base 11: mod_base = OTHER; note = 2'-fluorouridine
  modified_base 12: mod_base = gm
  modified_base 13: mod_base = gm
  modified_base 14: mod_base = gm
  modified_base 15: mod_base = um
  modified_base 16: mod_base = um
  modified_base 17: mod_base = um
  modified_base 18: mod_base = um
  modified_base 19: mod_base = cm
  modified_base 20: mod_base = um
  modified_base 21: mod_base = OTHER; note = 2'-O-methyladenosine
  source 1..21: mol_type = other RNA
gatgaggatttgggttttcta

SEQ ID NO: 1242 - RNA, 21 nt, synthetic construct
  modified_base 1: mod_base = gm
  modified_base 2: mod_base = OTHER; note = 2'-O-methyladenosine
  modified_base 3: mod_base = um
  modified_base 4: mod_base = gm
  modified_base 5: mod_base = OTHER; note = 2'-O-methyladenosine
  modified_base 6: mod_base = gm
  modified_base 7: mod_base = gm
  modified_base 8: mod_base = OTHER; note = 2'-O-methyladenosine
  modified_base 9: mod_base = OTHER; note = 2'-fluorouridine
  modified_base 10: mod_base = um
  modified_base 11: mod_base = OTHER; note = 2'-deoxy-5-methyluridine
  modified_base 12: mod_base = gm
  modified_base 13: mod_base = gm
  modified_base 14: mod_base = gm
  modified_base 15: mod_base = um
  modified_base 16: mod_base = um
  modified_base 17: mod_base = um
  modified_base 18: mod_base = um
  modified_base 19: mod_base = cm
  modified_base 20: mod_base = um
  modified_base 21: mod_base = OTHER; note = 2'-O-methyladenosine
  source 1..21: mol_type = other RNA
gatgaggatttgggttttcta

SEQ ID NO: 1243 - RNA, 21 nt, synthetic construct
  modified_base 1: mod_base = gm
  modified_base 2: mod_base = OTHER; note = 2'-O-methyladenosine
  modified_base 3: mod_base = um
  modified_base 4: mod_base = gm
  modified_base 5: mod_base = OTHER; note = 2'-O-methyladenosine
  modified_base 6: mod_base = gm
  modified_base 7: mod_base = gm
  modified_base 8: mod_base = OTHER; note = 2'-O-methyladenosine
  modified_base 9: mod_base = OTHER; note = 2'-deoxy-5-methyluridine
  modified_base 10: mod_base = um
  modified_base 11: mod_base = OTHER; note = 2'-deoxy-5-methyluridine
  modified_base 12: mod_base = gm
  modified_base 13: mod_base = gm
  modified_base 14: mod_base = gm
  modified_base 15: mod_base = um
  modified_base 16: mod_base = um
  modified_base 17: mod_base = um
  modified_base 18: mod_base = um
  modified_base 19: mod_base = cm
  modified_base 20: mod_base = um
  modified_base 21: mod_base = OTHER; note = 2'-O-methyladenosine
  source 1..21: mol_type = other RNA
gatgaggatttgggttttcta

SEQ ID NO: 1244 - RNA, 21 nt, synthetic construct
  modified_base 1: mod_base = gm
  modified_base 2: mod_base = OTHER; note = 2'-O-methyladenosine
  modified_base 3: mod_base = um
  modified_base 4: mod_base = gm
  modified_base 5: mod_base = OTHER; note = 2'-O-methyladenosine
  modified_base 6: mod_base = gm
  modified_base 7: mod_base = gm
  modified_base 8: mod_base = OTHER; note = 2'-O-methyladenosine
  modified_base 9: mod_base = OTHER; note = uridine
  modified_base 10: mod_base = um
  modified_base 11: mod_base = OTHER; note = 2'-deoxy-5-methyluridine
  modified_base 12: mod_base = gm
  modified_base 13: mod_base = gm
  modified_base 14: mod_base = gm
  modified_base 15: mod_base = um
  modified_base 16: mod_base = um
  modified_base 17: mod_base = um
  modified_base 18: mod_base = um
  modified_base 19: mod_base = cm
  modified_base 20: mod_base = um
  modified_base 21: mod_base = OTHER; note = 2'-O-methyladenosine
  source 1..21: mol_type = other RNA
gatgaggatttgggttttcta

SEQ ID NO: 1245 - RNA, 21 nt, synthetic construct
  modified_base 1: mod_base = gm
  modified_base 2: mod_base = OTHER; note = 2'-O-methyladenosine
  modified_base 3: mod_base = um
  modified_base 4: mod_base = gm
  modified_base 5: mod_base = OTHER; note = 2'-O-methyladenosine
  modified_base 6: mod_base = gm
  modified_base 7: mod_base = gm
  modified_base 8: mod_base = OTHER; note = 2'-O-methyladenosine
  modified_base 9: mod_base = OTHER; note = 2'-deoxy-5-methyluridine
  modified_base 10: mod_base = um
  modified_base 11: mod_base = OTHER; note = uridine
  modified_base 12: mod_base = gm
  modified_base 13: mod_base = gm
  modified_base 14: mod_base = gm
  modified_base 15: mod_base = um
  modified_base 16: mod_base = um
  modified_base 17: mod_base = um
  modified_base 18: mod_base = um
  modified_base 19: mod_base = cm
  modified_base 20: mod_base = um
  modified_base 21: mod_base = OTHER; note = 2'-O-methyladenosine
  source 1..21: mol_type = other RNA
gatgaggatttgggttttcta

SEQ ID NO: 1246 - RNA, 19 nt, synthetic construct
  modified_base 1: mod_base = um
  modified_base 2: mod_base = gm
  modified_base 3: mod_base = OTHER; note = 2'-O-methyladenosine
  modified_base 4: mod_base = gm
  modified_base 5: mod_base = gm
  modified_base 6: mod_base = OTHER; note = 2'-O-methyladenosine
  modified_base 7: mod_base = OTHER; note = 2'-fluorouridine
  modified_base 8: mod_base = um
  modified_base 9: mod_base = OTHER; note = 2'-fluorouridine
  modified_base 10: mod_base = OTHER; note = 2'-fluoroguanosine
  modified_base 11: mod_base = gm
  modified_base 12: mod_base = gm
  modified_base 13: mod_base = um
  modified_base 14: mod_base = um
  modified_base 15: mod_base = um
  modified_base 16: mod_base = um
  modified_base 17: mod_base = cm
  modified_base 18: mod_base = um
  modified_base 19: mod_base = OTHER; note = 2'-O-methyladenosine
  source 1..19: mol_type = other RNA
tgaggatttgggttttcta

SEQ ID NO: 1247 - RNA, 19 nt, synthetic construct
  modified_base 1: mod_base = um
  modified_base 1^2: mod_base = OTHER; note = phosphorothioate linkage
  modified_base 2: mod_base = gm
  modified_base 3: mod_base = OTHER; note = 2'-O-methyladenosine
  modified_base 4: mod_base = gm
  modified_base 5: mod_base = gm
  modified_base 6: mod_base = OTHER; note = 2'-O-methyladenosine
  modified_base 7: mod_base = OTHER; note = 2'-fluorouridine
  modified_base 8: mod_base = um
  modified_base 9: mod_base = OTHER; note = 2'-fluorouridine
  modified_base 10: mod_base = OTHER; note = 2'-fluoroguanosine
  modified_base 11: mod_base = gm
  modified_base 12: mod_base = gm
  modified_base 13: mod_base = um
  modified_base 14: mod_base = um
  modified_base 15: mod_base = um
  modified_base 16: mod_base = um
  modified_base 17: mod_base = cm
  modified_base 18: mod_base = um
  modified_base 19: mod_base = OTHER; note = 2'-O-methyladenosine
  source 1..19: mol_type = other RNA
tgaggatttgggttttcta

SEQ ID NO: 1248 - RNA, 21 nt, synthetic construct
  modified_base 1: mod_base = gm
  modified_base 2: mod_base = cm
  modified_base 3: mod_base = um
  modified_base 4: mod_base = gm
  modified_base 5: mod_base = um
  modified_base 6: mod_base = gm
  modified_base 7: mod_base = gm
  modified_base 8: mod_base = um
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluorouridine
  modified_base 12: mod_base = um
  modified_base 13: mod_base = gm
  modified_base 14: mod_base = OTHER; note = 2'-O-methyladenosine
  modified_base 15: mod_base = gm
  modified_base 16: mod_base = um
  modified_base 17: mod_base = OTHER; note = 2'-O-methyladenosine
  modified_base 18: mod_base = cm
  modified_base 19: mod_base = um
  modified_base 20: mod_base = um
  modified_base 21: mod_base = OTHER; note = 2'-O-methyladenosine
  source 1..21: mol_type = other RNA
gctgtggtgtttgagtactta

SEQ ID NO: 1249 - RNA, 21 nt, synthetic construct
  modified_base 1: mod_base = gm
  modified_base 2: mod_base = gm
  modified_base 3: mod_base = OTHER; note = 2'-O-methyladenosine
  modified_base 4: mod_base = cm
  modified_base 5: mod_base = cm
  modified_base 6: mod_base = cm
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = um
  modified_base 11: mod_base = OTHER; note = 2'-fluoroadenosine
  modified_base 12: mod_base = cm
  modified_base 13: mod_base = um
  modified_base 14: mod_base = gm
  modified_base 15: mod_base = um
  modified_base 16: mod_base = cm
  modified_base 17: mod_base = OTHER; note = 2'-O-methyladenosine
  modified_base 18: mod_base = um
  modified_base 19: mod_base = um
  modified_base 20: mod_base = gm
  modified_base 21: mod_base = OTHER; note = 2'-O-methyladenosine
  source 1..21: mol_type = other RNA
ggacccaattactgtcattga

SEQ ID NO: 1250 - RNA, 21 nt, synthetic construct
  modified_base 1: mod_base = gm
  modified_base 2: mod_base = gm
  modified_base 3: mod_base = OTHER; note = 2'-O-methyladenosine
  modified_base 4: mod_base = cm
  modified_base 5: mod_base = cm
  modified_base 6: mod_base = cm
  modified_base 7: mod_base = OTHER; note = 2'-O-methyladenosine
  modified_base 8: mod_base = OTHER; note = 2'-O-methyladenosine
  modified_base 9: mod_base = OTHER; note = 2'-fluorouridine
  modified_base 10: mod_base = um
  modified_base 11: mod_base = OTHER; note = 2'-fluoroadenosine
  modified_base 12: mod_base = OTHER; note = 2'-fluorocytidine
  modified_base 13: mod_base = um
  modified_base 14: mod_base = gm
  modified_base 15: mod_base = um
  modified_base 16: mod_base = cm
  modified_base 17: mod_base = OTHER; note = 2'-O-methyladenosine
  modified_base 18: mod_base = um
  modified_base 19: mod_base = um
  modified_base 20: mod_base = gm
  modified_base 21: mod_base = OTHER; note = 2'-O-methyladenosine
  source 1..21: mol_type = other RNA
ggacccaattactgtcattga

SEQ ID NO: 1251 - RNA, 21 nt, synthetic construct
  modified_base 1: mod_base = gm
  modified_base 2: mod_base = gm
  modified_base 3: mod_base = OTHER; note = 2'-O-methyladenosine
  modified_base 4: mod_base = cm
  modified_base 5: mod_base = cm
  modified_base 6: mod_base = cm
  modified_base 7: mod_base = OTHER; note = 2'-fluoroadenosine
  modified_base 8: mod_base = OTHER; note = 2'-O-methyladenosine
  modified_base 9: mod_base = OTHER; note = 2'-fluorouridine
  modified_base 10: mod_base = um
  modified_base 11: mod_base = OTHER; note = 2'-fluoroadenosine
  modified_base 12: mod_base = cm
  modified_base 13: mod_base = um
  modified_base 14: mod_base = gm
  modified_base 15: mod_base = um
  modified_base 16: mod_base = cm
  modified_base 17: mod_base = OTHER; note = 2'-O-methyladenosine
  modified_base 18: mod_base = um
  modified_base 19: mod_base = um
  modified_base 20: mod_base = gm
  modified_base 21: mod_base = OTHER; note = 2'-O-methyladenosine
  source 1..21: mol_type = other RNA
ggacccaattactgtcattga

SEQ ID NO: 1252 - RNA, 19 nt, synthetic construct
  modified_base 1: mod_base = um
  modified_base 2: mod_base = gm
  modified_base 3: mod_base = um
  modified_base 4: mod_base = gm
  modified_base 5: mod_base = gm
  modified_base 6: mod_base = um
  modified_base 7: mod_base = OTHER; note = 2'-fluoroguanosine
  modified_base 8: mod_base = OTHER; note = 2'-fluorouridine
  modified_base 9: mod_base = OTHER; note = 2'-fluorocytidine
  modified_base 10: mod_base = um
  modified_base 11: mod_base = gm
  modified_base 12: mod_base = OTHER; note = 2'-O-methyladenosine
  modified_base 13: mod_base = gm
  modified_base 14: mod_base = um
  modified_base 15: mod_base = OTHER; note = 2'-O-methyladenosine
  modified_base 16: mod_base = cm
  modified_base 17: mod_base = um
  modified_base 18: mod_base = um
  modified_base 19: mod_base = um
  source 1..19: mol_type = other RNA
tgtggtgtctgagtacttt

SEQ ID NO: 1253 - RNA, 19 nt, synthetic construct
  modified_base 1: mod_base = cm
  modified_base 2: mod_base = gm
  modified_base 3: mod_base = um
  modified_base 4: mod_base = gm
  modified_base 5: mod_base = gm
  modified_base 6: mod_base = um
  modified_base 7: mod_base = OTHER; note = 2'-fluoroguanosine
  modified_base 8: mod_base = OTHER; note = 2'-fluorouridine
  modified_base 9: mod_base = OTHER; note = 2'-fluorocytidine
  modified_base 10: mod_base = um
  modified_base 11: mod_base = gm
  modified_base 12: mod_base = OTHER; note = 2'-O-methyladenosine
  modified_base 13: mod_base = gm
  modified_base 14: mod_base = um
  modified_base 15: mod_base = OTHER; note = 2'-O-methyladenosine
  modified_base 16: mod_base = cm
  modified_base 17: mod_base = um
  modified_base 18: mod_base = um
  modified_base 19: mod_base = um
  source 1..19: mol_type = other RNA
cgtggtgtctgagtacttt

SEQ ID NO: 1254 - RNA, 19 nt, synthetic construct
  modified_base 1: mod_base = gm
  modified_base 2: mod_base = gm
  modified_base 3: mod_base = um
  modified_base 4: mod_base = gm
  modified_base 5: mod_base = gm
  modified_base 6: mod_base = um
  modified_base 7: mod_base = OTHER; note = 2'-fluoroguanosine
  modified_base 8: mod_base = OTHER; note = 2'-fluorouridine
  modified_base 9: mod_base = OTHER; note = 2'-fluorocytidine
  modified_base 10: mod_base = um
  modified_base 11: mod_base = gm
  modified_base 12: mod_base = OTHER; note = 2'-O-methyladenosine
  modified_base 13: mod_base = gm
  modified_base 14: mod_base = um
  modified_base 15: mod_base = OTHER; note = 2'-O-methyladenosine
  modified_base 16: mod_base = cm
  modified_base 17: mod_base = um
  modified_base 18: mod_base = um
  modified_base 19: mod_base = um
  source 1..19: mol_type = other RNA
ggtggtgtctgagtacttt

SEQ ID NO: 1255 - RNA, 21 nt, synthetic construct
  modified_base 1: mod_base = gm
  modified_base 2: mod_base = cm
  modified_base 3: mod_base = um
  modified_base 4: mod_base = gm
  modified_base 5: mod_base = um
  modified_base 6: mod_base = gm
  modified_base 7: mod_base = gm
  modified_base 8: mod_base = um
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = OTHER; note = 2'-O-methyladenosine
  modified_base 15: mod_base = gm
  modified_base 16: mod_base = um
  modified_base 17: mod_base = OTHER; note = 2'-O-methyladenosine
  modified_base 18: mod_base = cm
  modified_base 19: mod_base = um
  modified_base 20: mod_base = um
  modified_base 21: mod_base = OTHER; note = 2'-O-methyladenosine
  source 1..21: mol_type = other RNA
gctgtggtgtctgagtactta

SEQ ID NO: 1256 - RNA, 21 nt, synthetic construct
  modified_base 1: mod_base = gm
  modified_base 2: mod_base = gm
  modified_base 3: mod_base = um
  modified_base 4: mod_base = gm
  modified_base 5: mod_base = OTHER; note = 2'-O-methyladenosine
  modified_base 6: mod_base = gm
  modified_base 7: mod_base = OTHER; note = 2'-fluoroguanosine
  modified_base 8: mod_base = OTHER; note = 2'-O-methyladenosine
  modified_base 9: mod_base = OTHER; note = 2'-fluorouridine
  modified_base 10: mod_base = um
  modified_base 11: mod_base = OTHER; note = 2'-fluorouridine
  modified_base 12: mod_base = gm
  modified_base 13: mod_base = gm
  modified_base 14: mod_base = gm
  modified_base 15: mod_base = um
  modified_base 16: mod_base = um
  modified_base 17: mod_base = um
  modified_base 18: mod_base = um
  modified_base 19: mod_base = cm
  modified_base 20: mod_base = um
  modified_base 21: mod_base = OTHER; note = 2'-O-methyladenosine
  source 1..21: mol_type = other RNA
ggtgaggatttgggttttcta

SEQ ID NO: 1257 - RNA, 19 nt, synthetic construct
  modified_base 1: mod_base = gm
  modified_base 1^2: mod_base = OTHER; note = phosphorothioate linkage
  modified_base 2: mod_base = gm
  modified_base 3: mod_base = um
  modified_base 4: mod_base = gm
  modified_base 5: mod_base = gm
  modified_base 6: mod_base = um
  modified_base 7: mod_base = OTHER; note = 2'-fluoroguanosine
  modified_base 8: mod_base = OTHER; note = 2'-fluorouridine
  modified_base 9: mod_base = OTHER; note = 2'-fluorocytidine
  modified_base 10: mod_base = um
  modified_base 11: mod_base = gm
  modified_base 12: mod_base = OTHER; note = 2'-O-methyladenosine
  modified_base 13: mod_base = gm
  modified_base 14: mod_base = um
  modified_base 15: mod_base = OTHER; note = 2'-O-methyladenosine
  modified_base 16: mod_base = cm
  modified_base 17: mod_base = um
  modified_base 18: mod_base = um
  modified_base 19: mod_base = um
  source 1..19: mol_type = other RNA
ggtggtgtctgagtacttt

SEQ ID NO: 1258 - RNA, 19 nt, synthetic construct
  modified_base 1: mod_base = cm
  modified_base 1^2: mod_base = OTHER; note = phosphorothioate linkage
  modified_base 2: mod_base = gm
  modified_base 3: mod_base = um
  modified_base 4: mod_base = gm
  modified_base 5: mod_base = gm
  modified_base 6: mod_base = um
  modified_base 7: mod_base = OTHER; note = 2'-fluoroguanosine
  modified_base 8: mod_base = OTHER; note = 2'-fluorouridine
  modified_base 9: mod_base = OTHER; note = 2'-fluorocytidine
  modified_base 10: mod_base = um
  modified_base 11: mod_base = gm
  modified_base 12: mod_base = OTHER; note = 2'-O-methyladenosine
  modified_base 13: mod_base = gm
  modified_base 14: mod_base = um
  modified_base 15: mod_base = OTHER; note = 2'-O-methyladenosine
  modified_base 16: mod_base = cm
  modified_base 17: mod_base = um
  modified_base 18: mod_base = um
  modified_base 19: mod_base = um
  source 1..19: mol_type = other RNA
cgtggtgtctgagtacttt

SEQ ID NO: 1259 - RNA, 19 nt, synthetic construct
  modified_base 1: mod_base = um
  modified_base 1^2: mod_base = OTHER; note = phosphorothioate linkage
  modified_base 2: mod_base = gm
  modified_base 3: mod_base = um
  modified_base 4: mod_base = gm
  modified_base 5: mod_base = gm
  modified_base 6: mod_base = um
  modified_base 7: mod_base = OTHER; note = 2'-fluoroguanosine
  modified_base 8: mod_base = OTHER; note = 2'-fluorouridine
  modified_base 9: mod_base = OTHER; note = 2'-fluorocytidine
  modified_base 10: mod_base = um
  modified_base 11: mod_base = gm
  modified_base 12: mod_base = OTHER; note = 2'-O-methyladenosine
  modified_base 13: mod_base = gm
  modified_base 14: mod_base = um
  modified_base 15: mod_base = OTHER; note = 2'-O-methyladenosine
  modified_base 16: mod_base = cm
  modified_base 17: mod_base = um
  modified_base 18: mod_base = um
  modified_base 19: mod_base = um
  source 1..19: mol_type = other RNA
tgtggtgtctgagtacttt

SEQ ID NO: 1260 - RNA, 18 nt, synthetic construct
  modified_base 1: mod_base = gm
  modified_base 1^2: mod_base = OTHER; note = phosphorothioate linkage
  modified_base 2: mod_base = gm
  modified_base 3: mod_base = um
  modified_base 4: mod_base = gm
  modified_base 5: mod_base = gm
  modified_base 6: mod_base = um
  modified_base 7: mod_base = OTHER; note = 2'-fluoroguanosine
  modified_base 8: mod_base = OTHER; note = 2'-fluorouridine
  modified_base 9: mod_base = OTHER; note = 2'-fluorocytidine
  modified_base 10: mod_base = um
  modified_base 11: mod_base = gm
  modified_base 12: mod_base = OTHER; note = 2'-O-methyladenosine
  modified_base 13: mod_base = gm
  modified_base 14: mod_base = um
  modified_base 15: mod_base = OTHER; note = 2'-O-methyladenosine
  modified_base 16: mod_base = cm
  modified_base 17: mod_base = um
  modified_base 18: mod_base = um
  source 1..18: mol_type = other RNA
ggtggtgtctgagtactt

SEQ ID NO: 1261 - RNA, 19 nt, synthetic construct
  modified_base 1: mod_base = gm
  modified_base 2: mod_base = gm
  modified_base 3: mod_base = OTHER; note = 2'-O-methyladenosine
  modified_base 4: mod_base = gm
  modified_base 5: mod_base = gm
  modified_base 6: mod_base = OTHER; note = 2'-O-methyladenosine
  modified_base 7: mod_base = OTHER; note = 2'-fluorouridine
  modified_base 8: mod_base = um
  modified_base 9: mod_base = OTHER; note = 2'-fluorouridine
  modified_base 10: mod_base = OTHER; note = 2'-fluoroguanosine
  modified_base 11: mod_base = gm
  modified_base 12: mod_base = gm
  modified_base 13: mod_base = um
  modified_base 14: mod_base = um
  modified_base 15: mod_base = um
  modified_base 16: mod_base = um
  modified_base 17: mod_base = cm
  modified_base 18: mod_base = um
  modified_base 19: mod_base = OTHER; note = 2'-O-methyladenosine
  source 1..19: mol_type = other RNA
ggaggatttgggttttcta

SEQ ID NO: 1262 - RNA, 19 nt, synthetic construct
  modified_base 1: mod_base = cm
  modified_base 2: mod_base = gm
  modified_base 3: mod_base = OTHER; note = 2'-O-methyladenosine
  modified_base 4: mod_base = gm
  modified_base 5: mod_base = gm
  modified_base 6: mod_base = OTHER; note = 2'-O-methyladenosine
  modified_base 7: mod_base = OTHER; note = 2'-fluorouridine
  modified_base 8: mod_base = um
  modified_base 9: mod_base = OTHER; note = 2'-fluorouridine
  modified_base 10: mod_base = OTHER; note = 2'-fluoroguanosine
  modified_base 11: mod_base = gm
  modified_base 12: mod_base = gm
  modified_base 13: mod_base = um
  modified_base 14: mod_base = um
  modified_base 15: mod_base = um
  modified_base 16: mod_base = um
  modified_base 17: mod_base = cm
  modified_base 18: mod_base = um
  modified_base 19: mod_base = OTHER; note = 2'-O-methyladenosine
  source 1..19: mol_type = other RNA
cgaggatttgggttttcta

SEQ ID NO: 1263 - RNA, 21 nt, synthetic construct
  modified_base 1: mod_base = gm
  modified_base 2: mod_base = cm
  modified_base 3: mod_base = um
  modified_base 4: mod_base = gm
  modified_base 5: mod_base = um
  modified_base 6: mod_base = OTHER; note = 2'-O-methyladenosine
  modified_base 7: mod_base = gm
  modified_base 8: mod_base = um
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = OTHER; note = 2'-O-methyladenosine
  modified_base 15: mod_base = gm
  modified_base 16: mod_base = um
  modified_base 17: mod_base = OTHER; note = 2'-O-methyladenosine
  modified_base 18: mod_base = cm
  modified_base 19: mod_base = um
  modified_base 20: mod_base = um
  modified_base 21: mod_base = OTHER; note = 2'-O-methyladenosine
  source 1..21: mol_type = other RNA
gctgtagtgtctgagtactta

SEQ ID NO: 1264 - RNA, 21 nt, synthetic construct
  modified_base 1: mod_base = gm
  modified_base 2: mod_base = cm
  modified_base 3: mod_base = um
  modified_base 4: mod_base = OTHER; note = 2'-O-methyladenosine
  modified_base 5: mod_base = um
  modified_base 6: mod_base = gm
  modified_base 7: mod_base = gm
  modified_base 8: mod_base = um
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = OTHER; note = 2'-O-methyladenosine
  modified_base 15: mod_base = gm
  modified_base 16: mod_base = um
  modified_base 17: mod_base = OTHER; note = 2'-O-methyladenosine
  modified_base 18: mod_base = cm
  modified_base 19: mod_base = um
  modified_base 20: mod_base = um
  modified_base 21: mod_base = OTHER; note = 2'-O-methyladenosine
  source 1..21: mol_type = other RNA
gctatggtgtctgagtactta

SEQ ID NO: 1265 - RNA, 21 nt, synthetic construct
  modified_base 1: mod_base = gm
  modified_base 2: mod_base = cm
  modified_base 3: mod_base = um
  modified_base 4: mod_base = gm
  modified_base 5: mod_base = um
  modified_base 6: mod_base = gm
  modified_base 7: mod_base = gm
  modified_base 8: mod_base = um
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluoroguanosine
  modified_base 12: mod_base = um
  modified_base 13: mod_base = gm
  modified_base 14: mod_base = OTHER; note = 2'-O-methyladenosine
  modified_base 15: mod_base = gm
  modified_base 16: mod_base = um
  modified_base 17: mod_base = OTHER; note = 2'-O-methyladenosine
  modified_base 18: mod_base = cm
  modified_base 19: mod_base = um
  modified_base 20: mod_base = um
  modified_base 21: mod_base = OTHER; note = 2'-O-methyladenosine
  source 1..21: mol_type = other RNA
gctgtggtgtgtgagtactta

SEQ ID NO: 1266 - RNA, 21 nt, synthetic construct
  modified_base 1: mod_base = gm
  modified_base 2: mod_base = cm
  modified_base 3: mod_base = um
  modified_base 4: mod_base = gm
  modified_base 5: mod_base = um
  modified_base 6: mod_base = um
  modified_base 7: mod_base = gm
  modified_base 8: mod_base = um
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluoroguanosine
  modified_base 12: mod_base = um
  modified_base 13: mod_base = gm
  modified_base 14: mod_base = OTHER; note = 2'-O-methyladenosine
  modified_base 15: mod_base = gm
  modified_base 16: mod_base = gm
  modified_base 17: mod_base = OTHER; note = 2'-O-methyladenosine
  modified_base 18: mod_base = cm
  modified_base 19: mod_base = um
  modified_base 20: mod_base = um
  modified_base 21: mod_base = OTHER; note = 2'-O-methyladenosine
  source 1..21: mol_type = other RNA
gctgttgtgtgtgaggactta

SEQ ID NO: 1267 - RNA, 21 nt, synthetic construct
  source 1..21: mol_type = other RNA
tatctagcaccaggtagatgc

SEQ ID NO: 1268 - RNA, 21 nt, synthetic construct
  source 1..21: mol_type = other RNA
tcatctagcaccaggtagatg

SEQ ID NO: 1269 - RNA, 21 nt, synthetic construct
  source 1..21: mol_type = other RNA
tccatctagcaccaggtagat

SEQ ID NO: 1270 - RNA, 21 nt, synthetic construct
  source 1..21: mol_type = other RNA
atccatctagcaccaggtaga

SEQ ID NO: 1271 - RNA, 21 nt, synthetic construct
  source 1..21: mol_type = other RNA
tgatccatctagcaccaggta

SEQ ID NO: 1272 - RNA, 21 nt, synthetic construct
  source 1..21: mol_type = other RNA
tgtctgatccatctagcacca

SEQ ID NO: 1273 - RNA, 21 nt, synthetic construct
  source 1..21: mol_type = other RNA
atgctgtctgatccatctagc

SEQ ID NO: 1274 - RNA, 21 nt, synthetic construct
  source 1..21: mol_type = other RNA
tatgccacagagactcagaga

SEQ ID NO: 1275 - RNA, 21 nt, synthetic construct
  source 1..21: mol_type = other RNA
aaagtactcagacaccacagc

SEQ ID NO: 1276 - RNA, 21 nt, synthetic construct
  source 1..21: mol_type = other RNA
tacaccaacttgaatgaaacg

SEQ ID NO: 1277 - RNA, 21 nt, synthetic construct
  source 1..21: mol_type = other RNA
tactactccccagctgattac

SEQ ID NO: 1278 - RNA, 21 nt, synthetic construct
  source 1..21: mol_type = other RNA
tccactactccccagctgatc

SEQ ID NO: 1279 - RNA, 21 nt, synthetic construct
  source 1..21: mol_type = other RNA
tacatccactactccccagct

SEQ ID NO: 1280 - RNA, 21 nt, synthetic construct
  source 1..21: mol_type = other RNA
tagacatccactactccccag

SEQ ID NO: 1281 - RNA, 21 nt, synthetic construct
  source 1..21: mol_type = other RNA
aacccaaatcctcatcttgga

SEQ ID NO: 1282 - RNA, 21 nt, synthetic construct
  source 1..21: mol_type = other RNA
aaacccaaatcctcatcttgg

SEQ ID NO: 1283 - RNA, 21 nt, synthetic construct
  source 1..21: mol_type = other RNA
tagaaaacccaaatcctcatc

SEQ ID NO: 1284 - RNA, 21 nt, synthetic construct
  source 1..21: mol_type = other RNA
agtgtaaccgtcatagcagtg

SEQ ID NO: 1285 - RNA, 21 nt, synthetic construct
  source 1..21: mol_type = other RNA
tttgactagacactttttggc

SEQ ID NO: 1286 - RNA, 21 nt, synthetic construct
  source 1..21: mol_type = other RNA
aagttgactagacactttttg

SEQ ID NO: 1287 - RNA, 21 nt, synthetic construct
  source 1..21: mol_type = other RNA
taccataacttgccaccttct

SEQ ID NO: 1288 - RNA, 21 nt, synthetic construct
  source 1..21: mol_type = other RNA
tcatgttgtgcaatccatcag

SEQ ID NO: 1289 - RNA, 21 nt, synthetic construct
  source 1..21: mol_type = other RNA
tcatcaatgacagtaattggg

SEQ ID NO: 1290 - RNA, 21 nt, synthetic construct
  source 1..21: mol_type = other RNA
tcattgatgttcacttggttc

SEQ ID NO: 1291 - RNA, 21 nt, synthetic construct
  source 1..21: mol_type = other RNA
ttgcttgtggtaatcggtacc

SEQ ID NO: 1292 - RNA, 21 nt, synthetic construct
  source 1..21: mol_type = other RNA
tgttgcttgtggtaatcggtg

SEQ ID NO: 1293 - RNA, 21 nt, synthetic construct
  source 1..21: mol_type = other RNA
ttgagatcttggcctgccatg

SEQ ID NO: 1294 - RNA, 21 nt, synthetic construct
  source 1..21: mol_type = other RNA
tcttgatcagggcaacgtcac

SEQ ID NO: 1295 - RNA, 21 nt, synthetic construct
  source 1..21: mol_type = other RNA
agcttgatcagggcaacgtca

SEQ ID NO: 1296 - RNA, 21 nt, synthetic construct
  source 1..21: mol_type = other RNA
taagccagaaggacacacgta

SEQ ID NO: 1297 - RNA, 21 nt, synthetic construct
  source 1..21: mol_type = other RNA
aaagagatctcatcactcaca

SEQ ID NO: 1298 - RNA, 21 nt, synthetic construct
  source 1..21: mol_type = other RNA
tgaaagagatctcatcactca

SEQ ID NO: 1299 - RNA, 21 nt, synthetic construct
  source 1..21: mol_type = other RNA
tacatgaaggagtcttggcag

SEQ ID NO: 1300 - RNA, 21 nt, synthetic construct
  source 1..21: mol_type = other RNA
tcgtacatgaaggagtcttgg

SEQ ID NO: 1301 - RNA, 21 nt, synthetic construct
  source 1..21: mol_type = other RNA
ttgtcgtacatgaaggagtct

SEQ ID NO: 1302 - RNA, 21 nt, synthetic construct
  source 1..21: mol_type = other RNA
atcgactccttctatggtctc

SEQ ID NO: 1303 - RNA, 21 nt, synthetic construct
  source 1..21: mol_type = other RNA
tcaggtagatgttcatggagc

SEQ ID NO: 1304 - RNA, 21 nt, synthetic construct
  source 1..21: mol_type = other RNA
tctagcaccaggtagatgttc

SEQ ID NO: 1305 - RNA, 21 nt, synthetic construct
  source 1..21: mol_type = other RNA
tcccaatgctgtctgatccac

SEQ ID NO: 1306 - RNA, 21 nt, synthetic construct
  source 1..21: mol_type = other RNA
tgactagacactttttggctc

SEQ ID NO: 1307 - RNA, 21 nt, synthetic construct
  source 1..21: mol_type = other RNA
accataacttgccaccttctc

SEQ ID NO: 1308 - RNA, 21 nt, synthetic construct
  source 1..21: mol_type = other RNA
tttggcttcacaccataactc

SEQ ID NO: 1309 - RNA, 21 nt, synthetic construct
  source 1..21: mol_type = other RNA
tcatcatgctgtacactgcct

SEQ ID NO: 1310 - RNA, 21 nt, synthetic construct
  source 1..21: mol_type = other RNA
tcaatgacagtaattgggtcc

SEQ ID NO: 1311 - RNA, 21 nt, synthetic construct
  source 1..21: mol_type = other RNA
atcaatgacagtaattgggtc

SEQ ID NO: 1312 - RNA, 21 nt, synthetic construct
  source 1..21: mol_type = other RNA
tggatctcatcaatgacagtg

SEQ ID NO: 1313 - RNA, 21 nt, synthetic construct
  source 1..21: mol_type = other RNA
tagacatccagataatcctcc

SEQ ID NO: 1314 - RNA, 21 nt, synthetic construct
  source 1..21: mol_type = other RNA
aaacacatagacatccagatg

SEQ ID NO: 1315 - RNA, 21 nt, synthetic construct
  source 1..21: mol_type = other RNA
tcaaacacatagacatccaga

SEQ ID NO: 1316 - RNA, 21 nt, synthetic construct
  source 1..21: mol_type = other RNA
aaagcattgatgttcacttgg

SEQ ID NO: 1317 - RNA, 21 nt, synthetic construct
  source 1..21: mol_type = other RNA
agccaaagcattgatgttcac

SEQ ID NO: 1318 - RNA, 21 nt, synthetic construct
  source 1..21: mol_type = other RNA
taagccaaagcattgatgttc

SEQ ID NO: 1319 - RNA, 21 nt, synthetic construct
  source 1..21: mol_type = other RNA
tgttgctcattgtctttcttg

SEQ ID NO: 1320 - RNA, 21 nt, synthetic construct
  source 1..21: mol_type = other RNA
acatgttgctcattgtctttc

SEQ ID NO: 1321 - RNA, 21 nt, synthetic construct
  source 1..21: mol_type = other RNA
agcacaaagtactcagacacc

SEQ ID NO: 1322 - RNA, 21 nt, synthetic construct
  source 1..21: mol_type = other RNA
tagcacaaagtactcagacac

SEQ ID NO: 1323 - RNA, 21 nt, synthetic construct
  source 1..21: mol_type = other RNA
aaacaatgtgctgctgtcagc

SEQ ID NO: 1324 - RNA, 21 nt, synthetic construct
  source 1..21: mol_type = other RNA
tagaaaacccaaatcctcacc

SEQ ID NO: 1325 - RNA, 21 nt, synthetic construct
  source 1..21: mol_type = other RNA
tagaaaacccaaatcctcagc

SEQ ID NO: 1326 - RNA, 21 nt, synthetic construct
  source 1..21: mol_type = other RNA
taagtactcagacaccacagc

SEQ ID NO: 1327 - RNA, 21 nt, synthetic construct
  source 1..21: mol_type = other RNA
agaaaacccaaatcctcatct

SEQ ID NO: 1328 - RNA, 19 nt, synthetic construct
  source 1..19: mol_type = other RNA
tagaaaacccaaatcctca

SEQ ID NO: 1329 - RNA, 21 nt, synthetic construct
  source 1..21: mol_type = other RNA
taagtacttagacaccacagc

SEQ ID NO: 1330 - RNA, 21 nt, synthetic construct
  source 1..21: mol_type = other RNA
taagtactcagataccacagc

SEQ ID NO: 1331 - RNA, 21 nt, synthetic construct
  source 1..21: mol_type = other RNA
taagtactcagacatcacagc

SEQ ID NO: 1332 - RNA, 21 nt, synthetic construct
  source 1..21: mol_type = other RNA
taagtactcagacactacagc

SEQ ID NO: 1333 - RNA, 21 nt, synthetic construct
  source 1..21: mol_type = other RNA
taagtactcagacaccatagc

SEQ ID NO: 1334 - RNA, 21 nt, synthetic construct
  modified_base 1: mod_base = i
  source 1..21: mol_type = other RNA
nagaaaacccaaatcctcatc

SEQ ID NO: 1335 - RNA, 19 nt, synthetic construct
  source 1..19: mol_type = other RNA
aaagtactcagacaccaca

SEQ ID NO: 1336 - RNA, 21 nt, synthetic construct
  source 1..21: mol_type = other RNA
aaagtactcagacaccacggc

SEQ ID NO: 1337 - RNA, 21 nt, synthetic construct
  source 1..21: mol_type = other RNA
aaagtactcagacaccaccgc

SEQ ID NO: 1338 - RNA, 19 nt, synthetic construct
  source 1..19: mol_type = other RNA
aaagtactcagacaccacc

SEQ ID NO: 1339 - RNA, 19 nt, synthetic construct
  source 1..19: mol_type = other RNA
aaagtactcagacaccacg

SEQ ID NO: 1340 - RNA, 19 nt, synthetic construct
  modified_base 19: mod_base = OTHER; note = 2-aminoadenine-containing nucleotide
  source 1..19: mol_type = other RNA
aaagtactcagacaccacn

SEQ ID NO: 1341 - RNA, 19 nt, synthetic construct
  source 1..19: mol_type = other RNA
taagtactcagacaccacc

SEQ ID NO: 1342 - RNA, 21 nt, synthetic construct
  source 1..21: mol_type = other RNA
tagaaaacccaaatcctcctc

SEQ ID NO: 1343 - RNA, 21 nt, synthetic construct
  source 1..21: mol_type = other RNA
tagaaaacccaaatcctcgtc

SEQ ID NO: 1344 - RNA, 21 nt, synthetic construct
  modified_base 1: mod_base = i
  source 1..21: mol_type = other RNA
naagtactcagacaccacagc

SEQ ID NO: 1345 - RNA, 21 nt, synthetic construct
  source 1..21: mol_type = other RNA
taagtactcacacactacagc

SEQ ID NO: 1346 - RNA, 21 nt, synthetic construct
  source 1..21: mol_type = other RNA
taagtcctcacacacaacagc

SEQ ID NO: 1347 - RNA, 21 nt, synthetic construct
  source 1..21: mol_type = other RNA
gcatctacctggtgctagata

SEQ ID NO: 1348 - RNA, 21 nt, synthetic construct
  source 1..21: mol_type = other RNA
catctacctggtgctagatga

SEQ ID NO: 1349 - RNA, 21 nt, synthetic construct
  modified_base 19: mod_base = i
  source 1..21: mol_type = other RNA
atctacctggtgctagatnga

SEQ ID NO: 1350 - RNA, 21 nt, synthetic construct
  modified_base 18: mod_base = i
  source 1..21: mol_type = other RNA
tctacctggtgctagatngat

SEQ ID NO: 1351 - RNA, 21 nt, synthetic construct
  modified_base 17: mod_base = i
  source 1..21: mol_type = other RNA
tacctggtgctagatgnatca

SEQ ID NO: 1352 - RNA, 21 nt, synthetic construct
  modified_base 18: mod_base = i
  source 1..21: mol_type = other RNA
tggtgctagatggatcanaca

SEQ ID NO: 1353 - RNA, 21 nt, synthetic construct
  modified_base 18: mod_base = i
  source 1..21: mol_type = other RNA
gctagatggatcagacancat

SEQ ID NO: 1354 - RNA, 21 nt, synthetic construct
  modified_base 17: mod_base = i
  source 1..21: mol_type = other RNA
tctctgagtctctgtgncata

SEQ ID NO: 1355 - RNA, 21 nt, synthetic construct
  source 1..21: mol_type = other RNA
gctgtggtgtctgagtacttt

SEQ ID NO: 1356 - RNA, 21 nt, synthetic construct
  modified_base 17: mod_base = i
  source 1..21: mol_type = other RNA
cgtttcattcaagttgntgta

SEQ ID NO: 1357 - RNA, 21 nt, synthetic construct
  modified_base 3: mod_base = OTHER; note = 2-aminoadenine-containing nucleotide
  source 1..21: mol_type = other RNA
gtnatcagctggggagtagta

SEQ ID NO: 1358 - RNA, 21 nt, synthetic construct
  modified_base 19: mod_base = i
  source 1..21: mol_type = other RNA
gatcagctggggagtagtnga

SEQ ID NO: 1359 - RNA, 21 nt, synthetic construct
  modified_base 16: mod_base = i
  source 1..21: mol_type = other RNA
agctggggagtagtgnatgta

SEQ ID NO: 1360 - RNA, 21 nt, synthetic construct
  source 1..21: mol_type = other RNA
ctggggagtagtggatgtcta

SEQ ID NO: 1361 - RNA, 21 nt, synthetic construct
  modified_base 18: mod_base = i
  source 1..21: mol_type = other RNA
tccaagatgaggatttgngtt

SEQ ID NO: 1362 - RNA, 21 nt, synthetic construct
  modified_base 17: mod_base = i
  source 1..21: mol_type = other RNA
ccaagatgaggatttgngttt

SEQ ID NO: 1363 - RNA, 21 nt, synthetic construct
  source 1..21: mol_type = other RNA
gatgaggatttgggttttcta

SEQ ID NO: 1364 - RNA, 21 nt, synthetic construct
  source 1..21: mol_type = other RNA
cactgctatgacggttacact

SEQ ID NO: 1365 - RNA, 21 nt, synthetic construct
  source 1..21: mol_type = other RNA
gccaaaaagtgtctagtcaaa

SEQ ID NO: 1366 - RNA, 21 nt, synthetic construct
  modified_base 2: mod_base = OTHER; note = 2-aminoadenine-containing nucleotide
  source 1..21: mol_type = other RNA
cnaaaagtgtctagtcaactt

SEQ ID NO: 1367 - RNA, 21 nt, synthetic construct
  source 1..21: mol_type = other RNA
agaaggtggcaagttatggta

SEQ ID NO: 1368 - RNA, 21 nt, synthetic construct
  source 1..21: mol_type = other RNA
ctgatggattgcacaacatga

SEQ ID NO: 1369 - RNA, 21 nt, synthetic construct
  source 1..21: mol_type = other RNA
cccaattactgtcattgatga

SEQ ID NO: 1370 - RNA, 21 nt, synthetic construct
  source 1..21: mol_type = other RNA
gaaccaagtgaacatcaatga

SEQ ID NO: 1371 - RNA, 21 nt, synthetic construct
  modified_base 18: mod_base = i
  source 1..21: mol_type = other RNA
ggtaccgattaccacaancaa

SEQ ID NO: 1372 - RNA, 21 nt, synthetic construct
  modified_base 16: mod_base = i
  source 1..21: mol_type = other RNA
caccgattaccacaancaaca

SEQ ID NO: 1373 - RNA, 21 nt, synthetic construct
  source 1..21: mol_type = other RNA
catggcaggccaagatctcaa

SEQ ID NO: 1374 - RNA, 21 nt, synthetic construct
  source 1..21: mol_type = other RNA
gtgacgttgccctgatcaaga

SEQ ID NO: 1375 - RNA, 21 nt, synthetic construct
  modified_base 19: mod_base = i
  source 1..21: mol_type = other RNA
tgacgttgccctgatcaanct

SEQ ID NO: 1376 - RNA, 21 nt, synthetic construct
  modified_base 17: mod_base = i
  source 1..21: mol_type = other RNA
tacgtgtgtccttctgnctta

SEQ ID NO: 1377 - RNA, 21 nt, synthetic construct
  source 1..21: mol_type = other RNA
tgtgagtgatgagatctcttt

SEQ ID NO: 1378 - RNA, 21 nt, synthetic construct
  source 1..21: mol_type = other RNA
tgagtgatgagatctctttca

SEQ ID NO: 1379 - RNA, 21 nt, synthetic construct
  source 1..21: mol_type = other RNA
ctgccaagactccttcatgta

SEQ ID NO: 1380 - RNA, 21 nt, synthetic construct
  modified_base 20: mod_base = i
  source 1..21: mol_type = other RNA
ccaagactccttcatgtacna

SEQ ID NO: 1381 - RNA, 21 nt, synthetic construct
  modified_base 17: mod_base = i
  source 1..21: mol_type = other RNA
agactccttcatgtacnacaa

SEQ ID NO: 1382 - RNA, 21 nt, synthetic construct
  modified_base 16: mod_base = i
  source 1..21: mol_type = other RNA
gagaccatagaaggantcgat

SEQ ID NO: 1383 - RNA, 21 nt, synthetic construct
  modified_base 20: mod_base = i
  source 1..21: mol_type = other RNA
gctccatgaacatctacctna

SEQ ID NO: 1384 - RNA, 21 nt, synthetic construct
  modified_base 16: mod_base = i
  source 1..21: mol_type = other RNA
gaacatctacctggtnctaga

SEQ ID NO: 1385 - RNA, 21 nt, synthetic construct
  modified_base 19: mod_base = i
  source 1..21: mol_type = other RNA
gtggatcagacagcattgnga

SEQ ID NO: 1386 - RNA, 21 nt, synthetic construct
  modified_base 18: mod_base = i
  source 1..21: mol_type = other RNA
gagccaaaaagtgtctantca

SEQ ID NO: 1387 - RNA, 21 nt, synthetic construct
  source 1..21: mol_type = other RNA
gagaaggtggcaagttatggt

SEQ ID NO: 1388 - RNA, 21 nt, synthetic construct
  modified_base 16: mod_base = i
  source 1..21: mol_type = other RNA
gagttatggtgtgaanccaaa

SEQ ID NO: 1389 - RNA, 21 nt, synthetic construct
  source 1..21: mol_type = other RNA
aggcagtgtacagcatgatga

SEQ ID NO: 1390 - RNA, 21 nt, synthetic construct
  source 1..21: mol_type = other RNA
ggacccaattactgtcattga

SEQ ID NO: 1391 - RNA, 21 nt, synthetic construct
  source 1..21: mol_type = other RNA
gacccaattactgtcattgat

SEQ ID NO: 1392 - RNA, 21 nt, synthetic construct
  modified_base 16: mod_base = i
  source 1..21: mol_type = other RNA
cactgtcattgatganatcca

SEQ ID NO: 1393 - RNA, 21 nt, synthetic construct
  source 1..21: mol_type = other RNA
ggaggattatctggatgtcta

SEQ ID NO: 1394 - RNA, 21 nt, synthetic construct
  source 1..21: mol_type = other RNA
catctggatgtctatgtgttt

SEQ ID NO: 1395 - RNA, 21 nt, synthetic construct
  source 1..21: mol_type = other RNA
tctggatgtctatgtgtttga

SEQ ID NO: 1396 - RNA, 21 nt, synthetic construct
  source 1..21: mol_type = other RNA
ccaagtgaacatcaatgcttt

SEQ ID NO: 1397 - RNA, 21 nt, synthetic construct
  modified_base 19: mod_base = i
  source 1..21: mol_type = other RNA
gtgaacatcaatgctttgnct

SEQ ID NO: 1398 - RNA, 21 nt, synthetic construct
  modified_base 17: mod_base = i
  source 1..21: mol_type = other RNA
gaacatcaatgctttgnctta

SEQ ID NO: 1399 - RNA, 21 nt, synthetic construct
  modified_base 16: mod_base = i
  source 1..21: mol_type = other RNA
caagaaagacaatgancaaca

SEQ ID NO: 1400 - RNA, 21 nt, synthetic construct
  modified_base 2: mod_base = OTHER; note = 2-aminoadenine-containing nucleotide
  source 1..21: mol_type = other RNA
gnaagacaatgagcaacatgt

SEQ ID NO: 1401 - RNA, 21 nt, synthetic construct
  modified_base 19: mod_base = i
  source 1..21: mol_type = other RNA
ggtgtctgagtactttgtnct

SEQ ID NO: 1402 - RNA, 21 nt, synthetic construct
  modified_base 18: mod_base = i
  source 1..21: mol_type = other RNA
gtgtctgagtactttgtncta

SEQ ID NO: 1403 - RNA, 21 nt, synthetic construct
  source 1..21: mol_type = other RNA
gctgacagcagcacattgttt

SEQ ID NO: 1404 - RNA, 21 nt, synthetic construct
  source 1..21: mol_type = other RNA
ggtgaggatttgggttttcta

SEQ ID NO: 1405 - RNA, 21 nt, synthetic construct
  source 1..21: mol_type = other RNA
gctgaggatttgggttttcta

SEQ ID NO: 1406 - RNA, 21 nt, synthetic construct
  source 1..21: mol_type = other RNA
gctgtggtgtctgagtactta

SEQ ID NO: 1407 - RNA, 21 nt, synthetic construct
  source 1..21: mol_type = other RNA
agatgaggatttgggttttct

SEQ ID NO: 1408 - RNA, 19 nt, synthetic construct
  source 1..19: mol_type = other RNA
tgaggatttgggttttcta

SEQ ID NO: 1409 - RNA, 21 nt, synthetic construct
  source 1..21: mol_type = other RNA
gctgtggtgtttgagtactta

SEQ ID NO: 1410 - RNA, 19 nt, synthetic construct
  source 1..19: mol_type = other RNA
tgtggtgtctgagtacttt

SEQ ID NO: 1411 - RNA, 19 nt, synthetic construct
  source 1..19: mol_type = other RNA
cgtggtgtctgagtacttt

SEQ ID NO: 1412 - RNA, 19 nt, synthetic construct
  source 1..19: mol_type = other RNA
ggtggtgtctgagtacttt

SEQ ID NO: 1413 - RNA, 18 nt, synthetic construct
  source 1..18: mol_type = other RNA
ggtggtgtctgagtactt

SEQ ID NO: 1414 - RNA, 19 nt, synthetic construct
  source 1..19: mol_type = other RNA
ggaggatttgggttttcta

SEQ ID NO: 1415 - RNA, 19 nt, synthetic construct
  source 1..19: mol_type = other RNA
cgaggatttgggttttcta

SEQ ID NO: 1416 - RNA, 21 nt, synthetic construct
  source 1..21: mol_type = other RNA
gctgtagtgtctgagtactta

SEQ ID NO: 1417 - RNA, 21 nt, synthetic construct
  source 1..21: mol_type = other RNA
gctatggtgtctgagtactta

SEQ ID NO: 1418 - RNA, 21 nt, synthetic construct
  source 1..21: mol_type = other RNA
gctgtggtgtgtgagtactta

SEQ ID NO: 1419 - RNA, 21 nt, synthetic construct
  source 1..21: mol_type = other RNA
gctgttgtgtgtgaggactta

SEQ ID NO: 1420 - RNA, 21 nt, synthetic construct
  source 1..21: mol_type = other RNA
tagaaaacccaaatcctcatc

SEQ ID NO: 1421 - RNA, 21 nt, synthetic construct
  source 1..21: mol_type = other RNA
tagaaaacccaaatcctcatc

SEQ ID NO: 1422 - RNA, 21 nt, synthetic construct
  source 1..21: mol_type = other RNA
tcaatgacagtaattgggtcc

SEQ ID NO: 1423 - RNA, 21 nt, synthetic construct
  source 1..21: mol_type = other RNA
taagtactcagacaccatagc

SEQ ID NO: 1424 - RNA, 21 nt, synthetic construct
  source 1..21: mol_type = other RNA
taagtactcagacactacagc

SEQ ID NO: 1425 - RNA, 21 nt, synthetic construct
  source 1..21: mol_type = other RNA
taagtactcagacaccatagc

SEQ ID NO: 1426 - RNA, 21 nt, synthetic construct
  source 1..21: mol_type = other RNA
gatgaggatttgggttttcta

SEQ ID NO: 1427 - RNA, 21 nt, synthetic construct
  source 1..21: mol_type = other RNA
gatgaggatttgggttttcta

SEQ ID NO: 1428 - RNA, 21 nt, synthetic construct
  source 1..21: mol_type = other RNA
gatgaggatttgggttttcta

SEQ ID NO: 1429 - RNA, 21 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 3: mod_base = gm
  modified_base 4: mod_base = OTHER; note = 2'-fluoroadenosine
  modified_base 5: mod_base = OTHER; note = 2'-O-methyladenosine
  modified_base 6: mod_base = OTHER; note = 2'-O-methyladenosine
  modified_base 7: mod_base = OTHER; note = 2'-O-methyladenosine
  modified_base 8: mod_base = cm
  modified_base 9: mod_base = cm
  modified_base 10: mod_base = cm
  modified_base 11: mod_base = OTHER; note = 2'-O-methyladenosine
  modified_base 12: mod_base = OTHER; note = 2'-fluoroadenosine
  modified_base 13: mod_base = OTHER; note = 2'-O-methyladenosine
  modified_base 14: mod_base = OTHER; note = 2'-fluorouridine
  modified_base 15: mod_base = cm
  modified_base 16: mod_base = OTHER; note = 2'-fluorocytidine
  modified_base 17: mod_base = um
  modified_base 18: mod_base = cm
  modified_base 19: mod_base = OTHER; note = 2'-O-methyladenosine
  modified_base 20: mod_base = um
  modified_base 20^21: mod_base = OTHER; note = phosphorothioate linkage
  modified_base 20^21: mod_base = OTHER; note = phosphorothioate linkage
  modified_base 21: mod_base = cm
  source 1..21: mol_type = other RNA
tagaaaacccaaatcctcatc

SEQ ID NO: 1430 - RNA, 21 nt, synthetic construct
  modified_base 1: mod_base = OTHER; note = 2'-O-methyladenosine
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 4: mod_base = gm
  modified_base 5: mod_base = um
  modified_base 6: mod_base = OTHER; note = 2'-O-methyladenosine
  modified_base 7: mod_base = OTHER; note = 2'-fluorocytidine
  modified_base 8: mod_base = um
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = cm
  modified_base 14: mod_base = OTHER; note = 2'-fluoroadenosine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = cm
  modified_base 19: mod_base = OTHER; note = 2'-O-methyladenosine
  modified_base 20: mod_base = gm
  modified_base 20^21: mod_base = OTHER; note = phosphorothioate linkage
  modified_base 21: mod_base = um
  source 1..21: mol_type = other RNA
aaagtactcagacaccacagt

SEQ ID NO: 1431 - RNA, 19 nt, synthetic construct
  modified_base 1: mod_base = um
  modified_base 1^2: mod_base = OTHER; note = phosphorothioate linkage
  modified_base 2: mod_base = OTHER; note = 2'-fluoroadenosine
  modified_base 2^3: mod_base = OTHER; note = phosphorothioate linkage
  modified_base 3: mod_base = OTHER; note = 2'-O-methyladenosine
  modified_base 4: mod_base = gm
  modified_base 5: mod_base = um
  modified_base 6: mod_base = OTHER; note = 2'-O-methyladenosine
  modified_base 7: mod_base = OTHER; note = 2'-fluorocytidine
  modified_base 8: mod_base = um
  modified_base 9: mod_base = cm
  modified_base 10: mod_base = OTHER; note = 2'-O-methyladenosine
  modified_base 11: mod_base = gm
  modified_base 12: mod_base = OTHER; note = 2'-fluoroadenosine
  modified_base 13: mod_base = cm
  modified_base 14: mod_base = OTHER; note = 2'-fluoroadenosine
  modified_base 15: mod_base = cm
  modified_base 16: mod_base = OTHER; note = 2'-fluorocytidine
  modified_base 17: mod_base = OTHER; note = 2'-O-methyladenosine
  modified_base 18: mod_base = cm
  modified_base 18^19: mod_base = OTHER; note = phosphorothioate linkage
  modified_base 19: mod_base = cm
  source 1..19: mol_type = other RNA
taagtactcagacaccacc

SEQ ID NO: 1432 - RNA, 21 nt, synthetic construct
  modified_base 1: mod_base = gm
  modified_base 2: mod_base = OTHER; note = 2'-O-methyladenosine
  modified_base 3: mod_base = um
  modified_base 4: mod_base = gm
  modified_base 5: mod_base = OTHER; note = 2'-O-methyladenosine
  modified_base 6: mod_base = gm
  modified_base 7: mod_base = gm
  modified_base 8: mod_base = OTHER; note = 2'-O-methyladenosine
  modified_base 9: mod_base = OTHER; note = 2'-fluorouridine
  modified_base 10: mod_base = OTHER; note = 2'-fluorouridine
  modified_base 11: mod_base = OTHER; note = 2'-fluorouridine
  modified_base 12: mod_base = gm
  modified_base 13: mod_base = gm
  modified_base 14: mod_base = gm
  modified_base 15: mod_base = um
  modified_base 16: mod_base = um
  modified_base 17: mod_base = um
  modified_base 18: mod_base = um
  modified_base 19: mod_base = cm
  modified_base 20: mod_base = um
  modified_base 21: mod_base = OTHER; note = 2'-O-methyladenosine
  source 1..21: mol_type = other RNA
gatgaggatttgggttttcta

SEQ ID NO: 1433 - RNA, 21 nt, synthetic construct
  modified_base 1: mod_base = OTHER; note = 2'-O-methyladenosine
  modified_base 2: mod_base = cm
  modified_base 3: mod_base = um
  modified_base 4: mod_base = gm
  modified_base 5: mod_base = um
  modified_base 6: mod_base = gm
  modified_base 7: mod_base = gm
  modified_base 8: mod_base = um
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = OTHER; note = 2'-O-methyladenosine
  modified_base 15: mod_base = gm
  modified_base 16: mod_base = um
  modified_base 17: mod_base = OTHER; note = 2'-O-methyladenosine
  modified_base 18: mod_base = cm
  modified_base 19: mod_base = um
  modified_base 20: mod_base = um
  modified_base 21: mod_base = um
  source 1..21: mol_type = other RNA
actgtggtgtctgagtacttt

SEQ ID NO: 1434 - RNA, 19 nt, synthetic construct
  modified_base 1: mod_base = gm
  modified_base 2: mod_base = gm
  modified_base 3: mod_base = um
  modified_base 4: mod_base = gm
  modified_base 5: mod_base = gm
  modified_base 6: mod_base = um
  modified_base 7: mod_base = OTHER; note = 2'-fluoroguanosine
  modified_base 8: mod_base = OTHER; note = 2'-fluorouridine
  modified_base 9: mod_base = OTHER; note = 2'-fluorocytidine
  modified_base 10: mod_base = um
  modified_base 11: mod_base = gm
  modified_base 12: mod_base = OTHER; note = 2'-O-methyladenosine
  modified_base 13: mod_base = gm
  modified_base 14: mod_base = um
  modified_base 15: mod_base = OTHER; note = 2'-O-methyladenosine
  modified_base 16: mod_base = cm
  modified_base 17: mod_base = um
  modified_base 18: mod_base = um
  modified_base 19: mod_base = OTHER; note = 2'-O-methyladenosine
  source 1..19: mol_type = other RNA
ggtggtgtctgagtactta

SEQ ID NO: 1435 - RNA, 21 nt, synthetic construct
  modified_base 1: mod_base = OTHER; note = 2'-O-methyladenosine
  modified_base 2: mod_base = cm
  modified_base 3: mod_base = um
  modified_base 4: mod_base = gm
  modified_base 5: mod_base = um
  modified_base 6: mod_base = gm
  modified_base 7: mod_base = gm
  modified_base 8: mod_base = um
  modified_base 9: mod_base = OTHER; note = 2'-fluoroguanosine
  modified_base 10: mod_base = OTHER; note = 2'-fluorouridine
  modified_base 11: mod_base = OTHER; note = 2'-fluorocytidine
  modified_base 12: mod_base = um
  modified_base 13: mod_base = gm
  modified_base 14: mod_base = OTHER; note = 2'-O-methyladenosine
  modified_base 15: mod_base = gm
  modified_base 16: mod_base = um
  modified_base 17: mod_base = OTHER; note = 2'-O-methyladenosine
  modified_base 18: mod_base = cm
  modified_base 19: mod_base = um
  modified_base 20: mod_base = um
  modified_base 21: mod_base = um
  source 1..21: mol_type = other RNA
actgtggtgtctgagtacttt

SEQ ID NO: 1436 - RNA, 19 nt, synthetic construct
  modified_base 1: mod_base = gm
  modified_base 2: mod_base = gm
  modified_base 3: mod_base = um
  modified_base 4: mod_base = gm
  modified_base 5: mod_base = gm
  modified_base 6: mod_base = um
  modified_base 7: mod_base = OTHER; note = 2'-fluoroguanosine
  modified_base 8: mod_base = OTHER; note = 2'-fluorouridine
  modified_base 9: mod_base = OTHER; note = 2'-fluorocytidine
  modified_base 10: mod_base = um
  modified_base 11: mod_base = gm
  modified_base 12: mod_base = OTHER; note = 2'-O-methyladenosine
  modified_base 13: mod_base = gm
  modified_base 14: mod_base = um
  modified_base 15: mod_base = OTHER; note = 2'-O-methyladenosine
  modified_base 16: mod_base = cm
  modified_base 17: mod_base = um
  modified_base 18: mod_base = um
  modified_base 19: mod_base = OTHER; note = 2'-O-methyladenosine
  source 1..19: mol_type = other RNA
ggtggtgtctgagtactta

SEQ ID NO: 1437 - RNA, 21 nt, synthetic construct
  source 1..21: mol_type = other RNA
aaagtactcagacaccacagt

SEQ ID NO: 1438 - RNA, 21 nt, synthetic construct
  source 1..21: mol_type = other RNA
actgtggtgtctgagtacttt

SEQ ID NO: 1439 - RNA, 19 nt, synthetic construct
  source 1..19: mol_type = other RNA
tgtggtgtttgagtactta

The invention claimed is:

1. An RNAi agent for inhibiting expression of a complement factor B (CFB) gene, comprising:
an antisense strand wherein nucleotides 1-21 of the antisense strand (5'→3') comprise the nucleotide sequence (5'→3'): UAAGUACUCAGACACUACAGC (SEQ ID NO:1332);
and a sense strand that comprises the nucleotide sequence (5'→3'): GCUGUGGUGUCUGAGUACUUA (SEQ ID NO:1406); wherein all of the nucleotides of the antisense strand and all of the nucleotides of the sense strand are modified nucleotides, wherein the modified nucleotides are selected from the group consisting of 2'-fluoro modified nucleotides and 2'-O-methyl modified nucleotides, wherein the sense strand is covalently linked to a targeting ligand that comprises N-acetyl-galactosamine.

2. The RNAi agent of claim 1, wherein the targeting ligand is linked to the 5' terminal end of the sense strand.

3. The RNAi agent of claim 1, wherein the targeting ligand comprises:

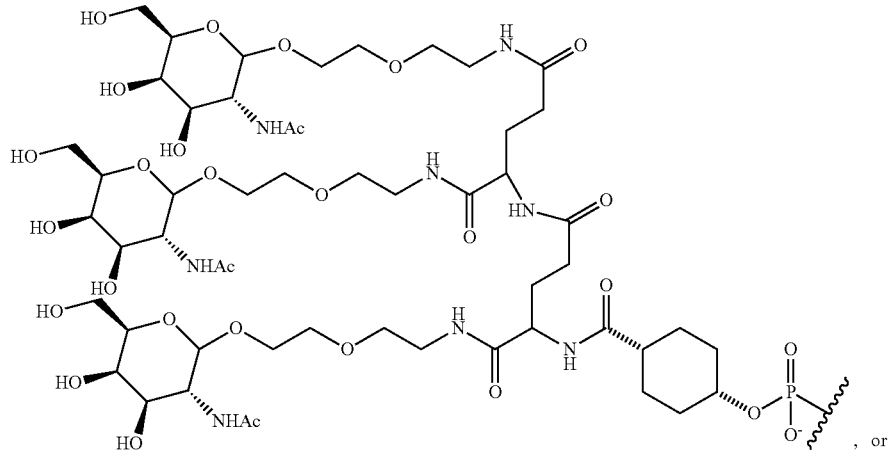

, or

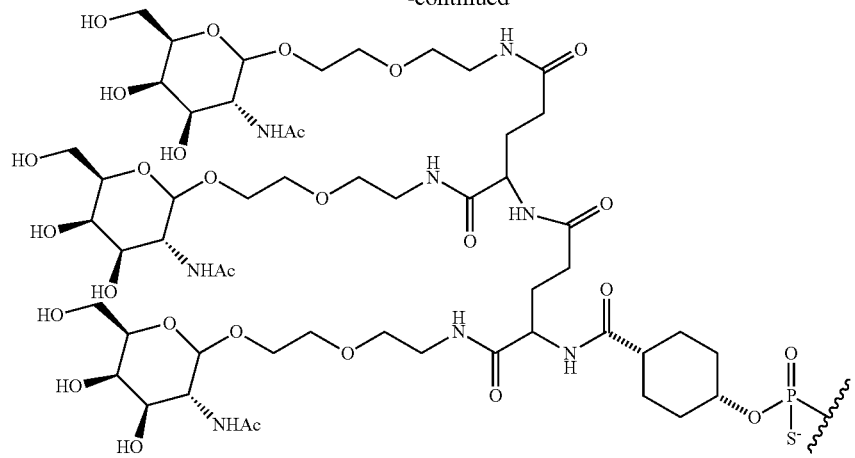

4. The RNAi agent of claim 1, wherein the sense strand and the antisense strand are each between 21 and 24 nucleotides in length.

5. The RNAi agent of claim 1, wherein the sense strand and the antisense strand are each 21 nucleotides in length.

6. The RNAi agent of claim 1, wherein the sense strand comprises one or two inverted abasic residues.

7. The RNAi agent of claim 1, comprising an antisense strand that comprises the modified nucleotide sequence (5'→3'): usAfsaguaCfucagAfcAfcUfacagsc (SEQ ID NO:1013); wherein a represents 2'-O-methyl adenosine, c represents 2'-O-methyl cytidine, g represents 2'-O-methyl guanosine, and u represents 2'-O-methyl uridine; Af, represents 2'-fluoro adenosine, Cf represents 2'-fluoro cytidine, Gf represents 2'-fluoro guanosine, and Uf represents 2'-fluoro uridine; and s represents a phosphorothioate linkage.

8. The RNAi agent of claim 7, wherein the sense strand comprises the modified nucleotide sequence (5'→3'): gcugugguGfUfCfugaguacuua (SEQ ID NO:1235); wherein a represents 2'-O-methyl adenosine, c represents 2'-O-methyl cytidine, g represents 2'-O-methyl guanosine, u represents 2'-O-methyl uridine; Af, represents 2'-fluoro adenosine, Cf represents 2'-fluoro cytidine, Gf represents 2'-fluoro guanosine, and Uf represents 2'-fluoro uridine.

9. The RNAi agent claim 8, wherein the sense strand further includes inverted abasic residues at the 3' terminal end of the nucleotide sequence, at the 5' end of the nucleotide sequence, or at both.

10. The RNAi agent of claim 1, wherein the antisense strand comprises the modified nucleotide sequence (5'→3'): usAfsaguaCfucagAfcAfcUfacagsc (SEQ ID NO:1013); and the sense strand comprises the modified nucleotide sequence (5'→3'): (NAG37)s(invAb)sgcugugguGfUfCfugaguacuuas (invAb) (SEQ ID NO:1136); wherein a represents 2'-O-methyl adenosine, c represents 2'-O-methyl cytidine, g represents 2'-O-methyl guanosine, u represents 2'-O-methyl uridine; Af, represents 2'-fluoro adenosine, Cf represents 2'-fluoro cytidine, Gf represents 2'-fluoro guanosine, and Uf represents 2'-fluoro uridine; s represents a phosphorothioate linkage; (invAb) represents an inverted abasic deoxyribonucleotide; and (NAG37)s represents the following chemical structure:

(NAG37)s

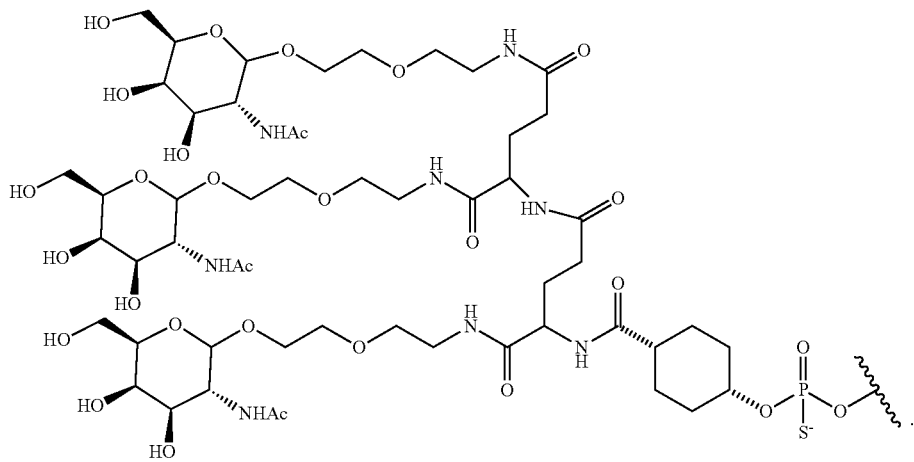

11. The RNAi agent of claim 1, wherein the RNAi agent is a pharmaceutically acceptable salt.

12. The RNAi agent of claim 11, wherein the RNAi agent is a sodium salt.

13. The RNAi agent of claim 10, wherein the RNAi agent is a pharmaceutically acceptable salt.

14. The RNAi agent of claim 13, wherein the RNAi agent is a sodium salt.

15. A pharmaceutical composition comprising the RNAi agent of claim 1, wherein the composition comprises a pharmaceutically acceptable excipient.

16. A pharmaceutical composition comprising the RNAi agent of claim 10, wherein the composition comprises a pharmaceutically acceptable excipient.

17. A pharmaceutical composition comprising the RNAi agent of claim 13, wherein the composition comprises a pharmaceutically acceptable excipient.

18. The pharmaceutical composition of claim 17, wherein the pharmaceutically acceptable excipient is isotonic saline.

19. The pharmaceutical composition of claim 17, wherein the pharmaceutically acceptable excipient is water for injection.

* * * * *